(12) United States Patent
Nicosia et al.

(10) Patent No.: US 11,098,324 B2
(45) Date of Patent: Aug. 24, 2021

(54) NON HUMAN GREAT APES ADENOVIRUS NUCLEIC ACID- AND AMINO ACID-SEQUENCES, VECTORS CONTAINING SAME, AND USES THEREOF

(71) Applicant: NOUSCOM AG, Basel (CH)

(72) Inventors: Alfredo Nicosia, Naples (IT); Stefano Colloca, Rome (IT); Armin Lahm, Rom (IT)

(73) Assignee: Nouscom AG, Basel (CH)

( * ) Notice: Subject to any disclaimer, the term of this patent is extended or adjusted under 35 U.S.C. 154(b) by 41 days.

(21) Appl. No.: 16/626,438

(22) PCT Filed: Jul. 5, 2018

(86) PCT No.: PCT/EP2018/068291
§ 371 (c)(1),
(2) Date: Feb. 13, 2020

(87) PCT Pub. No.: WO2019/008111
PCT Pub. Date: Jan. 10, 2019

(65) Prior Publication Data
US 2021/0130848 A1 May 6, 2021

(30) Foreign Application Priority Data
Jul. 5, 2017 (EP) .................................. 17179825

(51) Int. Cl.
| | | |
|---|---|---|
| C12Q 1/68 | (2018.01) | |
| C07K 14/435 | (2006.01) | |
| C07K 14/47 | (2006.01) | |
| A61K 48/00 | (2006.01) | |
| C12P 19/34 | (2006.01) | |
| C12N 15/86 | (2006.01) | |
| A61K 39/235 | (2006.01) | |
| C07K 14/005 | (2006.01) | |
| C12N 7/00 | (2006.01) | |
| A61K 39/00 | (2006.01) | |

(52) U.S. Cl.
CPC ............ *C12N 15/86* (2013.01); *A61K 39/235* (2013.01); *C07K 14/005* (2013.01); *C12N 7/00* (2013.01); *A61K 2039/53* (2013.01); *C12N 2710/10321* (2013.01); *C12N 2710/10322* (2013.01); *C12N 2710/10323* (2013.01); *C12N 2710/10343* (2013.01)

(58) Field of Classification Search
CPC ........ C12Q 2565/627; C12Q 2537/143; C12Q 1/6858; C07K 14/4703; A61K 38/00
See application file for complete search history.

(56) References Cited

FOREIGN PATENT DOCUMENTS

| WO | 2006/040330 | 4/2006 |
|---|---|---|
| WO | 2010/051367 | 5/2010 |
| WO | WO2010051367 | * 5/2010 |
| WO | 2013/116591 | 8/2013 |

OTHER PUBLICATIONS

Yan et al., "Interaction between hexon and L4-100K determines virus rescue and growth of hexon-chimeric recombinant Ad5 vectors", Scientific reports, 2016, 6(1):1-13.*
The International Search Report (ISR) with Written Opinion for PCT/EP2018/068291 dated Aug. 8, 2018, pp. 1-20.
Yan, Jingyi et al. "Interaction between hexon and L4-100K determines virus rescue and growth of hexon-chimeric recombinant Ad5 vectors" Scientific Reports (2016) vol. 6(1), pp. 1-13.
Mizuta, Katsumi et al. "Stability of the seven hexon hypervariable region sequences of adenovirus types 1-6 isolated in Yamagata, Japan between 1988 and 2007" Virus Research (2009) vol. 140(1-2), pp. 32-39.

* cited by examiner

*Primary Examiner* — Barry A Chestnut
(74) *Attorney, Agent, or Firm* — McDonnell Boehnen Hulbert & Berghoff LLP

(57) ABSTRACT

The present invention relates to novel adenovirus strains with a high immunogenicity and no pre-existing immunity in the general human population. The lack of pre-existing immunity is due to novel hypervariable regions in the adenoviral capsid protein hexon. The novel adenovirus strains also have an improved capacity for reproduction. The present invention provides nucleotide and amino acid sequences of these novel adenovirus strains, as well as recombinant viruses, virus-like particles and vectors based on these strains. Further provided are pharmaceutical compositions and medical uses in the therapy or prophylaxis of a disease, and methods for producing an adenovirus or virus-like particles utilizing the novel sequences, recombinant viruses, virus-like particles and vectors.

15 Claims, 5 Drawing Sheets

Figure 1:
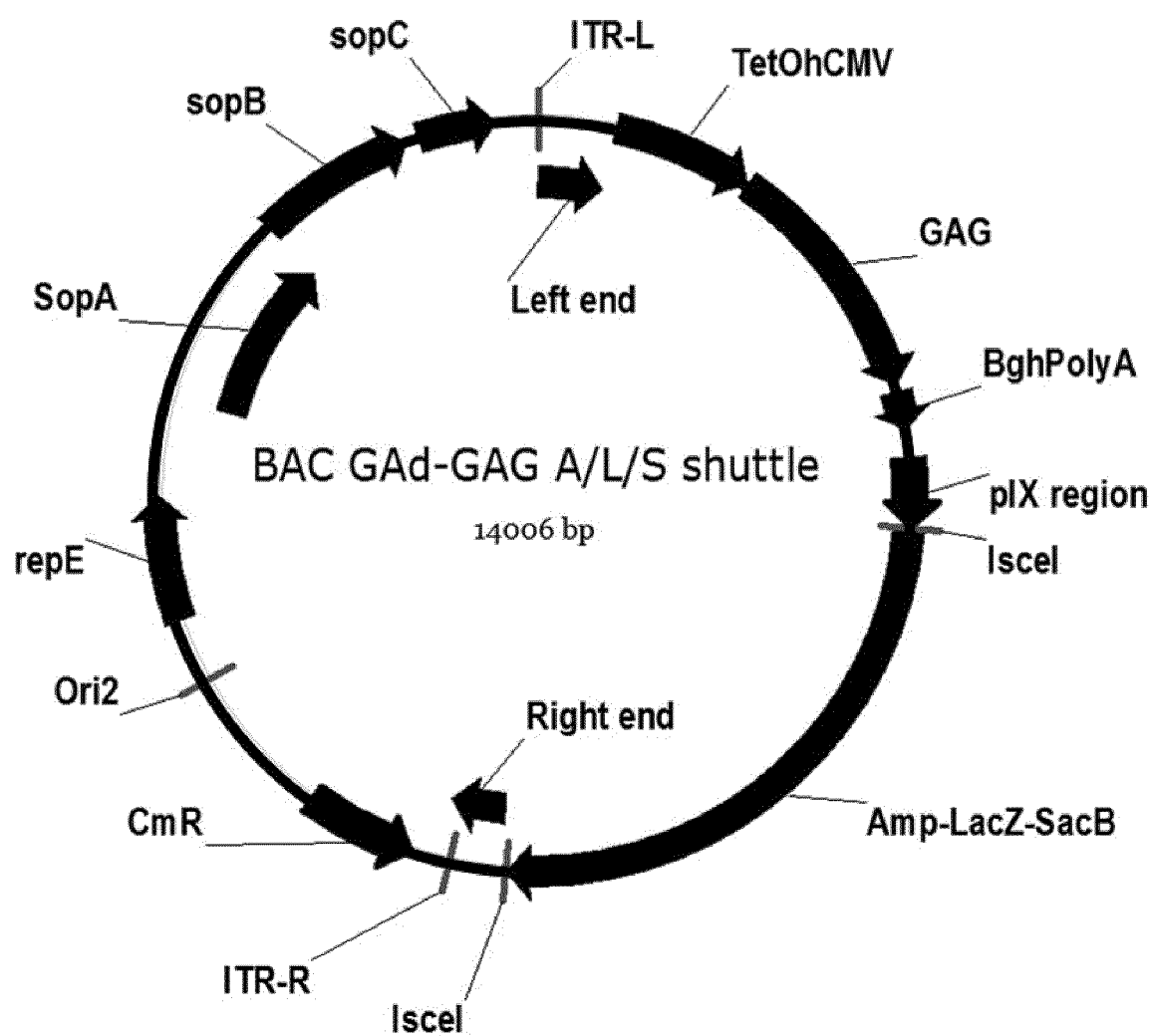

Specification includes a Sequence Listing.

NON HUMAN GREAT APES ADENOVIRUS NUCLEIC ACID- AND AMINO ACID-SEQUENCES, VECTORS CONTAINING SAME, AND USES THEREOF

CROSS-REFERENCE TO RELATED APPLICATION

This application is a U.S. national phase of International Application No. PCT/EP2018/068291, filed on Jul. 5, 2018, which claims priority to European Patent Application No. 17179825.9, filed Jul. 5, 2017, both of which are incorporated by reference herein in their entirety.

The present invention relates to novel adenovirus strains with a high immunogenicity and no pre-existing immunity in the general human population. The lack of pre-existing immunity is due to novel hypervariable regions in the adenoviral capsid protein hexon. The novel adenovirus strains also have an improved capacity for reproduction. The present invention provides nucleotide and amino acid sequences of these novel adenovirus strains, as well as recombinant viruses, virus-like particles and vectors based on these strains. Further provided are pharmaceutical compositions and medical uses in the therapy or prophylaxis of a disease, and methods for producing an adenovirus or virus-like particles utilizing the novel sequences, recombinant viruses, virus-like particles and vectors.

BACKGROUND OF THE INVENTION

The adenoviruses (Ads) comprise a large family of double-stranded DNA viruses found in amphibians, avians, and mammals which have a nonenveloped icosahedral capsid structure (Straus, Adenovirus infections in humans; *The Adenoviruses*, 451-498, 1984; Hierholzer et al., J. Infect. Dis., 158: 804-813, 1988; Schnurr and Dondero, *Intervirology*, 36: 79-83, 1993; Jong et al., *J. Clin. Microbiol.*, 37: 3940-3945: 1999). In contrast to retroviruses, adenoviruses can transduce numerous cell types of several mammalian species, including both dividing and non-dividing cells, without integrating into the genome of the host cell.

Generally speaking, adenoviral DNA is typically very stable and remains episomal (e.g., extrachromosomal), unless transformation or tumorigenesis occurs. In addition, adenoviral vectors can be propagated to high yields in well-defined production systems which are readily amenable to pharmaceutical scale production of clinical grade compositions. These characteristics and their well-characterized molecular genetics make recombinant adenoviral vectors good candidates for use as vaccine carriers. The production of recombinant adenoviral vectors may rely on the use of a packaging cell line which is capable of complementing the functions of adenoviral gene products that have been either deleted or engineered to be non-functional.

Presently, two well-characterized human subgroup C adenovirus serotypes (i.e., hAd2 and hAd5) are widely used as the sources of the viral backbone for most of the adenoviral vectors that are used for gene therapy. Replication-defective human adenoviral vectors have also been tested as vaccine carriers for the delivery of a variety of immunogens derived from a variety of infectious agents. Studies conducted in experimental animals (e. g. rodents, canines and nonhuman primates) indicate that recombinant replication-defective human adenoviral vectors carrying transgenes encoding immunogens as well as other antigens elicit both humoral and cell-mediated immune responses against the transgene product. Generally speaking, investigators have reported success using human adenoviral vectors as vaccine carriers in non human experimental systems by either using immunization protocols that utilizes high doses of recombinant adenoviral vectors that are predicted to elicit immune responses; or by using immunization protocols which employ the sequential administration of adenoviral vectors that are derived from different serotypes but which carry the same transgene product as boosting immunizations (Mastrangeli, et. al., Human Gene Therapy, 7: 79-87 (1996)).

Vectors derived from species C adenoviruses (e.g. Ad5, Ad6 and ChAd63) are the most immunogenic (Colloca et al., Sci. Transl. Med. 4 (115), 2012). In particular, viral vectors based on human adenovirus type 5 (Ad5) have been developed for gene therapy and vaccine applications. Although Ad5-based vectors are extremely efficient in animal models, the presence of a pre-existing immunity in humans against Ad5 wild type virus has in clinical trials been demonstrated to reduce the efficiency of gene transduction (Moore J P et al. Science. 2008 May 9; 320(5877):753-5). Thus, immunity in the general population limits the broad application of Ad vectored-vaccines based on Ad5. On the other hand, rare human adenoviruses are less immunogenic than Ad5 (Colloca et al., Sci. Transl. Med. 4 (115), 2012). Vectors based on non human adenoviruses do not have a pre-existing immunity in the general human population (Farina et al., J. Virol. 75 (23), 11603-11613, 2001).

Thus, there is a need for adenovirus vectors with high immunogenicity and a low or absent pre-existing immunity in humans. Preferably, these adenovirus vectors have a high productivity in terms of their replication.

SUMMARY OF THE INVENTION

In a first aspect, the invention provides an isolated polynucleotide encoding an adenovirus hexon protein comprising:
A) (i) a first hypervariable region HVR1 comprising an amino acid sequence according to SEQ ID NO: 11, or a variant thereof having at least 85% sequence identity to SEQ ID NO: 11 and with no A and preferably with a V at position 27,
(ii) a second hypervariable region HVR2 comprising an amino acid sequence according to SEQ ID NO: 12, or a variant thereof having at least 85% sequence identity to SEQ ID NO: 12 and with no L and preferably with an I at position 1,
(iii) a third hypervariable region HVR3 comprising an amino acid sequence according to SEQ ID NO: 13, or a variant thereof having at least 85% sequence identity to SEQ ID NO: 13 and with no V and preferably with an A at position 7,
(iv) a fourth hypervariable region HVR4 comprising an amino acid sequence according to SEQ ID NO: 14, or a variant thereof having at least 85% sequence identity to SEQ ID NO: 14,
(v) a fifth hypervariable region HVR5 comprising an amino acid sequence according to SEQ ID NO: 15, or a variant thereof having at least 85% sequence identity to SEQ ID NO: 15,
(vi) a sixth hypervariable region HVR6 comprising an amino acid sequence according to SEQ ID NO: 16, or a variant thereof having at least 85% sequence identity to SEQ ID NO: 16, and
(vii) a seventh hypervariable region HVR7 comprising an amino acid sequence according to SEQ ID NO: 17, or a variant thereof having at least 85% sequence identity to SEQ ID NO: 17 with no I and preferably with a V at position 1; or B) (i) a first hypervariable region HVR1 comprising an amino acid sequence according to SEQ ID NO: 18, or a variant thereof having at least 85% sequence identity to SEQ ID NO: 18 with no V and preferably with an E at position 8, with no D and preferably with an E at position 12, with no E and preferably with a D at position 13, and/or with no L and preferably with a V at position 14,
(ii) a second hypervariable region HVR2 comprising an amino acid sequence according to SEQ ID NO: 19, or a variant thereof having at least 85% sequence identity to SEQ ID NO: 19 with no D and preferably with an E at position 10,
(iii) a third hypervariable region HVR3 comprising an amino acid sequence according to SEQ ID NO: 20, or a variant thereof having at least 85% sequence identity to SEQ ID NO: 20 with no T and preferably with an A at position 6,
(iv) a fourth hypervariable region HVR4 comprising an amino acid sequence according to SEQ ID NO: 21, or a variant thereof having at least 85% sequence identity to SEQ ID NO: 21 with no L and preferably with a M at position 9,
(v) a fifth hypervariable region HVR5 comprising an amino acid sequence according to SEQ ID NO: 22, or a variant thereof having at least 85% sequence identity to SEQ ID NO: 22 with no T and preferably with an S at position 3,
(vi) a sixth hypervariable region HVR6 comprising an amino acid sequence according to SEQ ID NO: 23, or a variant thereof having at least 85% sequence identity to SEQ ID NO: 23 with no I and preferably with a V at position 9, and
(vii) a seventh hypervariable region HVR7 comprising an amino acid sequence according to SEQ ID NO: 24, or a variant thereof having at least 85% sequence identity to SEQ ID NO: 24 with no I and preferably with a V at position 8; or C) (i) a first hypervariable region HVR1 comprising an amino acid sequence according to SEQ ID NO: 25, or a variant thereof having at least 85% sequence identity to SEQ ID NO: 25,
(ii) a second hypervariable region HVR2 comprising an amino acid sequence according to SEQ ID NO: 26, or a variant thereof having at least 85% sequence identity to SEQ ID NO: 26,
(iii) a third hypervariable region HVR3 comprising an amino acid sequence according to SEQ ID NO: 27, or a variant thereof having at least 85% sequence identity to SEQ ID NO: 27 with no V and preferably with an A at position 7,
(iv) a fourth hypervariable region HVR4 comprising an amino acid sequence according to SEQ ID NO: 28, or a variant thereof having at least 85% sequence identity to SEQ ID NO: 28 with no E and preferably with a Q at position 10,
(v) a fifth hypervariable region HVR5 comprising an amino acid sequence according to SEQ ID NO: 29, or a variant thereof having at least 85% sequence identity to SEQ ID NO: 29 with no T and preferably with an S at position 3,
(vi) a sixth hypervariable region HVR6 comprising an amino acid sequence according to SEQ ID NO: 30, or a variant thereof having at least 85% sequence identity to SEQ ID NO: 30 with no I and preferably with a V at position 9, and
(vii) a seventh hypervariable region HVR7 comprising an amino acid sequence according to SEQ ID NO: 31, or a variant thereof having at least 85% sequence identity to SEQ ID NO: 31 with no I and preferably with a V at position 8 and/or with no T and preferably with an S at position 11; or D) (i) a first hypervariable region HVR1 comprising an amino acid sequence according to SEQ ID NO: 32, or a variant thereof having at least 85% sequence identity to SEQ ID NO: 32,
(ii) a second hypervariable region HVR2 comprising an amino acid sequence according to SEQ ID NO: 33, or a variant thereof having at least 85% sequence identity to SEQ ID NO: 33,
(iii) a third hypervariable region HVR3 comprising an amino acid sequence according to SEQ ID NO:34, or a variant thereof having at least 85% sequence identity to SEQ ID NO: 34 with no T and preferably with an A at position 6,
(iv) a fourth hypervariable region HVR4 comprising an amino acid sequence according to SEQ ID NO: 35, or a variant thereof having at least 85% sequence identity to SEQ ID NO: 35 with no Q and preferably with a K at position 6 and/or with no E and preferably with a Q at position 10,
(v) a fifth hypervariable region HVR5 comprising an amino acid sequence according to SEQ ID NO: 36, or a variant thereof having at least 85% sequence identity to SEQ ID NO: 36 with no T and preferably with an S at position 3,
(vi) a sixth hypervariable region HVR6 comprising an amino acid sequence according to SEQ ID NO: 37, or a variant thereof having at least 85% sequence identity to SEQ ID NO: 37 with no K and preferably with a T at position 1 and/or with no I and preferably with a V at position 9, and
(vii) a seventh hypervariable region HVR7 comprising an amino acid sequence according to SEQ ID NO: 38, or a variant thereof having at least 85% sequence identity to SEQ ID NO: 38 with no I and preferably with a V at position 8; or E) (i) a first hypervariable region HVR1 comprising an amino acid sequence according to SEQ ID NO: 39, or a variant thereof having at least 85% sequence identity to SEQ ID NO: 39 with no A and preferably with a V at position 27,
(ii) a second hypervariable region HVR2 comprising an amino acid sequence according to SEQ ID NO: 40, or a variant thereof having at least 85% sequence identity to SEQ ID NO: 40,
(iii) a third hypervariable region HVR3 comprising an amino acid sequence according to SEQ ID NO: 41, or a variant thereof having at least 85% sequence identity to SEQ ID NO: 41,
(iv) a fourth hypervariable region HVR4 comprising an amino acid sequence according to SEQ ID NO: 42, or a variant thereof having at least 85% sequence identity to SEQ ID NO: 42,
(v) a fifth hypervariable region HVR5 comprising an amino acid sequence according to SEQ ID NO: 43, or a variant thereof having at least 85% sequence identity to SEQ ID NO: 43, (vi) a sixth hypervariable region HVR6 comprising an amino acid sequence according to SEQ ID NO: 44, or a variant thereof having at least 85% sequence identity to SEQ ID NO: 44, and (vii) a seventh hypervariable region HVR7 comprising an amino acid sequence according to SEQ ID NO: 45, or a variant thereof having at least 85% sequence identity to SEQ ID NO: 45 with no I and preferably with a V at position 1.

In a second aspect, the invention provides an isolated polynucleotide encoding an adenovirus, preferably a replication-incompetent adenovirus comprising the polynucleotide the first aspect.

In a third aspect, the invention provides at least one isolated adenoviral capsid polypeptide encoded by an isolated polynucleotide of the first aspect.

In a fourth aspect, the invention provides an adenovirus encoded by an isolated polynucleotide of the first aspect or an isolated adenovirus, preferably a replication-incompetent adenovirus, comprising an isolated polynucleotide according to the first aspect and/or at least one isolated adenoviral capsid polypeptide according to the third aspect.

In a fifth aspect, the invention provides a virus-like particle encoded by an isolated polynucleotide of the first aspect.

In a sixth aspect, the invention provides a vector comprising an isolated polynucleotide of the first aspect.

In a seventh aspect, the invention provides a composition comprising (i) an adjuvant, (ii) an isolated polynucleotide of the first or second aspect, at least one isolated adenoviral capsid polypeptide of the third aspect, an adenovirus of the fourth aspect, a virus-like particle of the fifth aspect, or a vector of the sixth aspect, and optionally (iii) a pharmaceutically acceptable excipient.

In an eighth aspect, the invention provides a cell comprising an isolated polynucleotide of the first or second aspect, at least one isolated adenoviral capsid polypeptide of the third aspect, an adenovirus of the fourth aspect, a virus-like particle of the fifth aspect, or a vector of the sixth aspect.

In a ninth aspect, the invention provides an isolated polynucleotide of the first or second aspect, at least one isolated adenoviral capsid polypeptide of the third aspect, an adenovirus of the fourth aspect, a virus-like particle of the fifth aspect, or a vector of the sixth aspect and/or the composition of the seventh aspect for use in treating or preventing a disease.

In a tenth aspect, the invention relates to an in vitro method for producing an adenovirus or an adenovirus-like particle, comprising the steps of (i) expressing an isolated polynucleotide of the first or second aspect in a cell such that an adenovirus or an adenovirus-like particle is assembled in the cell, (ii) isolating the adenovirus or the adenovirus-like particle from the cell or the medium surrounding the cell.

DETAILED DESCRIPTION OF THE INVENTION

Before the present invention is described in detail below, it is to be understood that this invention is not limited to the particular methodology, protocols and reagents described herein as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art.

Preferably, the terms used herein are defined as described in "A multilingual glossary of biotechnological terms: (IUPAC Recommendations)", Leuenberger, H. G. W, Nagel, B. and Klbl, H. eds. (1995), Helvetica Chimica Acta, CH-4010 Basel, Switzerland) and as described in "Pharmaceutical Substances: Syntheses, Patents, Applications" by Axel Kleemann and Jurgen Engel, Thieme Medical Publishing, 1999; the "Merck Index: An Encyclopedia of Chemicals, Drugs, and Biologicals", edited by Susan Budavari et al., CRC Press, 1996, and the United States Pharmacopeia-25/National Formulary-20, published by the United States Pharmcopeial Convention, Inc., Rockville Md., 2001.

Throughout this specification and the claims which follow, unless the context requires otherwise, the word "comprise", and variations such as "comprises" and "comprising", will be understood to imply the inclusion of a stated feature, integer or step or group of features, integers or steps but not the exclusion of any other feature, integer or step or group of integers or steps. In the following passages different aspects of the invention are defined in more detail. Each aspect so defined may be combined with any other aspect or aspects unless clearly indicated to the contrary. In particular, any feature indicated as being preferred or advantageous may be combined with any other feature or features indicated as being preferred or advantageous.

Several documents are cited throughout the text of this specification. Each of the documents cited herein (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention.

LEGENDS TO THE FIGURES

FIG. 1: Schematic view of the BAC GAd-GAG A/L/S shuttle vector.

Figure 2:
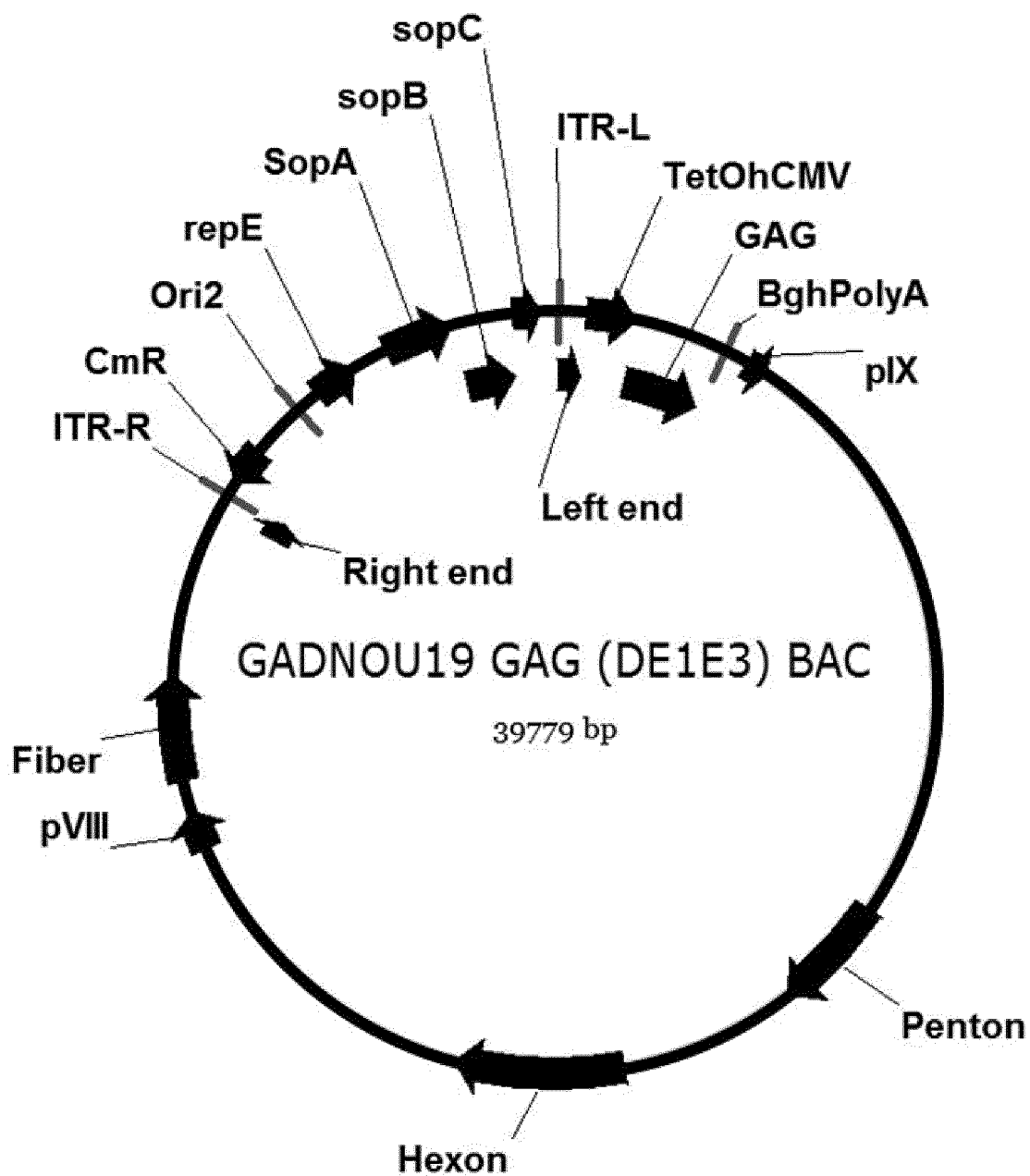

FIG. 2: Schematic view of the E1- and E3-deleted GAdNou19 GAG (DE1E3) BAC plasmid.

Figure 3:
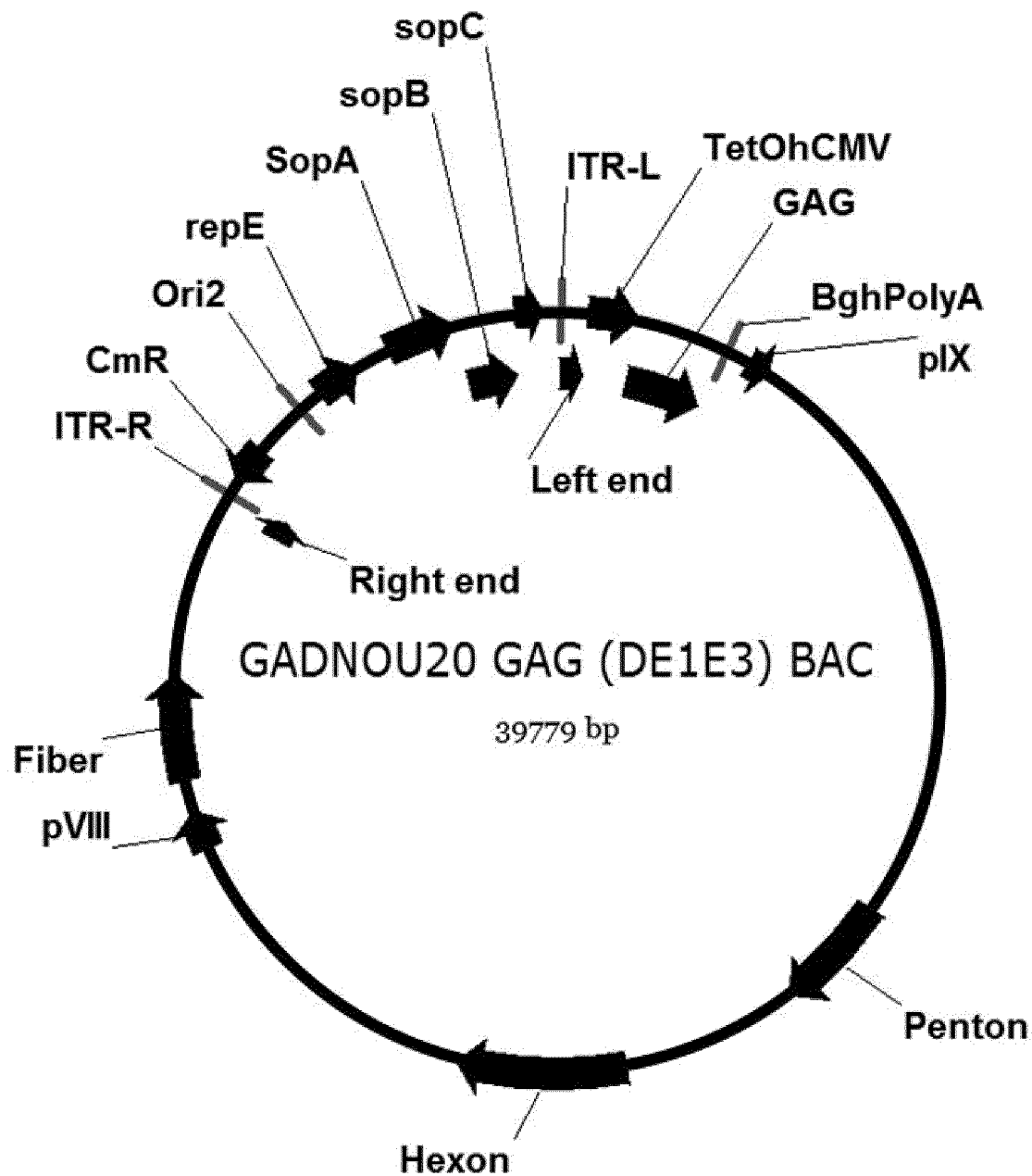

FIG. 3: Schematic view of the E1- and E3-deleted GAdNou20 GAG (DE1E3) BAC plasmid.

Figure 4:
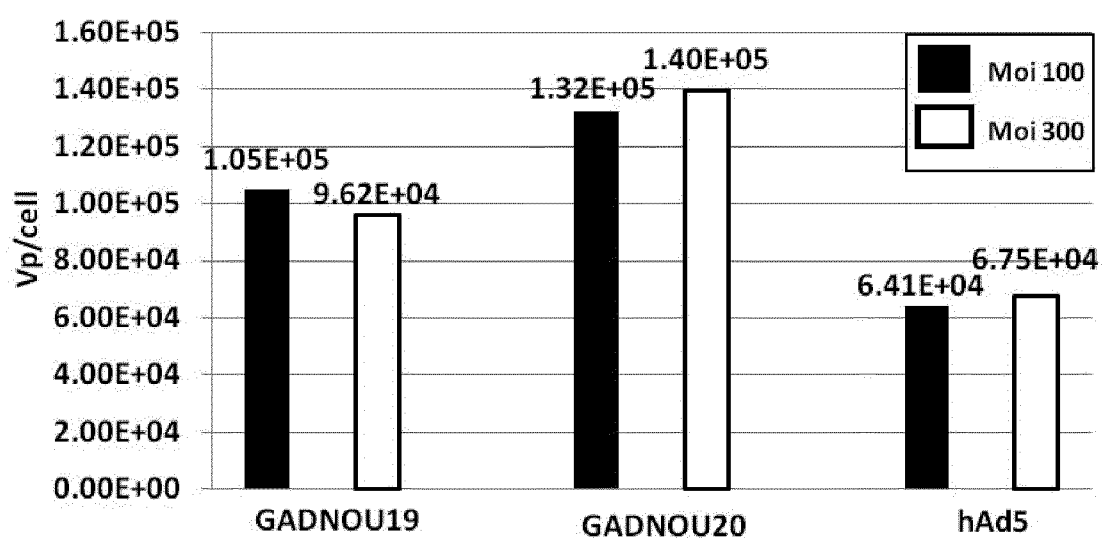

FIG. 4: Productivity of GADNOU19 and GADNOU20 in Hek293 compared to the benchmark Ad5 vector carrying the same expression cassette.

Figure 5:
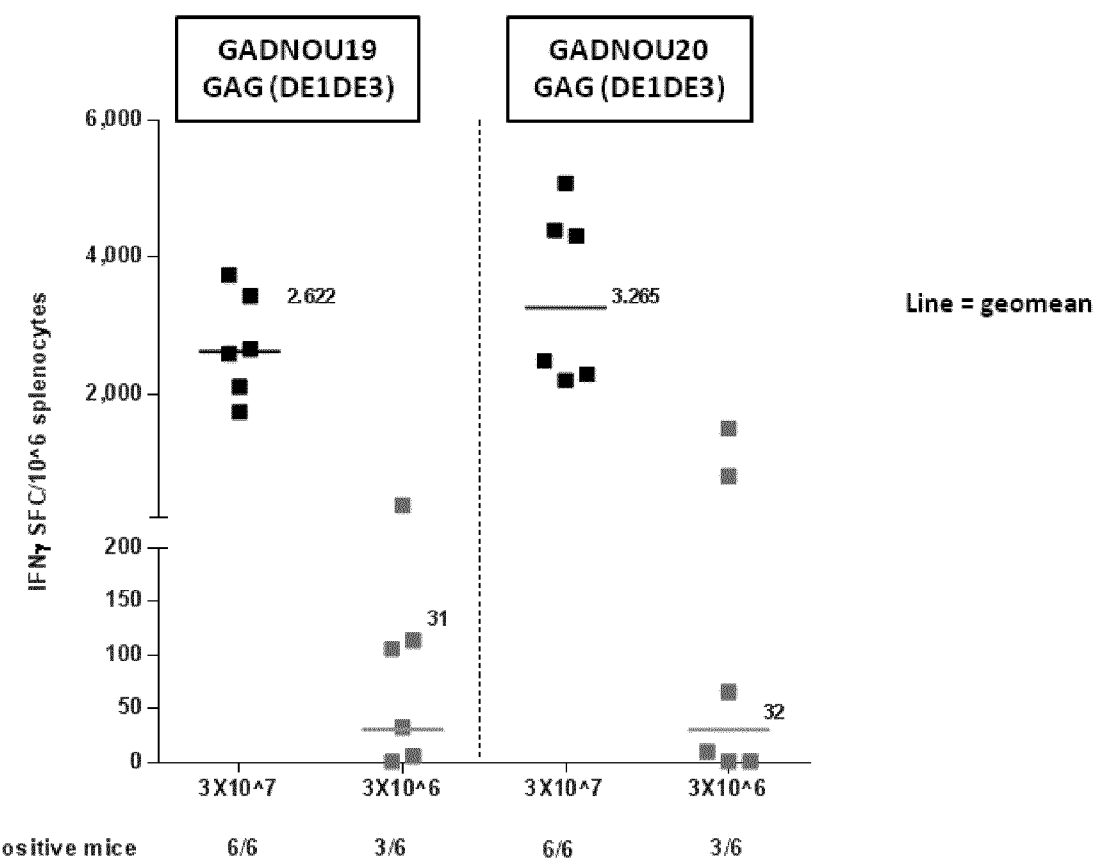

FIG. 5: Immunogenicity of GADNOU19 and GADNOU20 vectors encoding GAG antigen. Immunological potency of GADNOU19 GAG (DE1DE3) and GADNOU20 GAG (DE1DE3) vectors was determined by IFN-γ ELISpot. T cell responses are measured 3 weeks post immunization with $3\times10^{7}$ and $3\times10^{6}$ vp of each vector. Shown are the number of T cells producing IFNγ per millions of splenocytes in response to stimulation with the immunodominant gag peptide encoding a CD8+ epitope.

NUCLEOTIDE AND AMINO ACID SEQUENCES

The following Table 1 provides an overview over the sequences referred to herein (GADNOU+number: isolated adenoviral strain; *: corresponding nucleotide sequence of the GADNOU genome encoding the amino acid sequence, sequence correspondence is according to the listed order, e.g. for SEQ ID NO: 11, HVR1 GADNOU 20 corresponds to x-x of SEQ ID NO: 1, HVR1 GADNOU 21 corresponds to x-x of SEQ ID NO: 2, and HVR1 GADNOU 25 corresponds to x-x of SEQ ID NO: 3). GADNOU is the inventors' strain designation. The extent of the genomic coordinates for the hexon, penton, fiber given below (SEQ ID NOs 46-54 in the GADNOU genomes) does not include the final stop codon, which is optionally included/added in this disclosure when referring to a polynucleotide encoding hexon, penton or fiber using the coordinates.

TABLE 1

SEQ ID NOs referred to in the application

| SEQ ID NO | Polypeptide | Polynucleotide |
|---|---|---|
| 1 | | genome GADNOU 20 |
| 2 | | genome GADNOU 21 |
| 3 | | genome GADNOU 25 |
| 4 | | genome GADNOU 26 |
| 5 | | genome GADNOU 29 |
| 6 | | genome GADNOU 27 |
| 7 | | genome GADNOU 30 |
| 8 | | genome GADNOU 28 |
| 9 | | genome GADNOU 31 |
| 10 | | genome GADNOU 19 |
| 11 | HVR1 GADNOU 20, 21, 25 | * 19386-19472 of SEQ ID NO: 1, 2, 3 |
| 12 | HVR2 GADNOU 20, 21, 25 | * 19527-19571 of SEQ ID NO: 1, 2, 3 |
| 13 | HVR3 GADNOU 20, 21, 25 | * 19623-19643 of SEQ ID NO: 1, 2, 3 |
| 14 | HVR4 GADNOU 20, 21, 25 | * 19737-19772 of SEQ ID NO: 1, 2, 3 |
| 15 | HVR5 GADNOU 20, 21, 25 | * 19794-19838 of SEQ ID NO: 1, 2, 3 |
| 16 | HVR6 GADNOU 20, 21, 25 | * 19908-19934 of SEQ ID NO: 1, 2, 3 |
| 17 | HVR7 GADNOU 20, 21, 25 | * 20259-20336 of SEQ ID NO: 1, 2, 3 |
| 18 | HVR1 GADNOU 26, 29 | * 19386-19472 of SEQ ID NO: 4, 5 |
| 19 | HVR2 GADNOU 26, 29 | * 19527-19571 of SEQ ID NO: 4, 5 |
| 20 | HVR3 GADNOU 26, 29 | * 19623-19643 of SEQ ID NO: 4, 5 |
| 21 | HVR4 GADNOU 26, 29 | * 19737-19772 of SEQ ID NO: 4, 5 |
| 22 | HVR5 GADNOU 26, 29 | * 19794-19838 of SEQ ID NO: 4, 5 |
| 23 | HVR6 GADNOU 26, 29 | * 19908-19934 of SEQ ID NO: 4, 5 |
| 24 | HVR7 GADNOU 26, 29 | * 20259-20336 of SEQ ID NO: 4, 5 |
| 25 | HVR1 GADNOU 27, 30 | * 19386-19475 of SEQ ID NO: 6, 7 |
| 26 | HVR2 GADNOU 27, 30 | * 19530-19574 of SEQ ID NO: 6, 7 |
| 27 | HVR3 GADNOU 27, 30 | * 19626-19646 of SEQ ID NO: 6, 7 |
| 28 | HVR4 GADNOU 27, 30 | * 19740-19775 of SEQ ID NO: 6, 7 |
| 29 | HVR5 GADNOU 27, 30 | * 19797-19841 of SEQ ID NO: 6, 7 |
| 30 | HVR6 GADNOU 27, 30 | * 19911-19937 of SEQ ID NO: 6, 7 |
| 31 | HVR7 GADNOU 27, 30 | * 20262-20339 of SEQ ID NO: 6, 7 |
| 32 | HVR1 GADNOU 28, 31 | * 19386-19478 of SEQ ID NO: 8, 9 |
| 33 | HVR2 GADNOU 28, 31 | * 19533-19577 of SEQ ID NO: 8, 9 |
| 34 | HVR3 GADNOU 28, 31 | * 19629-19649 of SEQ ID NO: 8, 9 |
| 35 | HVR4 GADNOU 28, 31 | * 19743-19778 of SEQ ID NO: 8, 9 |
| 36 | HVR5 GADNOU 28, 31 | * 19800-19844 of SEQ ID NO: 8, 9 |
| 37 | HVR6 GADNOU 28, 31 | * 19914-19940 of SEQ ID NO: 8, 9 |
| 38 | HVR7 GADNOU 28, 31 | * 20265-20342 of SEQ ID NO: 8, 9 |
| 39 | HVR1 GADNOU 19 | * 19386-19472 of SEQ ID NO: 10 |
| 40 | HVR2 GADNOU 19 | * 19527-19571 of SEQ ID NO: 10 |
| 41 | HVR3 GADNOU 19 | * 19623-19643 of SEQ ID NO: 10 |
| 42 | HVR4 GADNOU 19 | * 19737-19772 of SEQ ID NO: 10 |
| 43 | HVR5 GADNOU 19 | * 19794-19838 of SEQ ID NO: 10 |
| 44 | HVR6 GADNOU 19 | * 19908-19934 of SEQ ID NO: 10 |
| 45 | HVR7 GADNOU 19 | * 20259-20336 of SEQ ID NO: 10 |
| 46 | Hexon GADNOU 20, 21, 25 | * 18981-21845 of SEQ ID NO: 1, 2, 3 |
| 47 | Hexon GADNOU 26, 29 | * 18981-21845 of SEQ ID NO: 4, 5 |
| 48 | Hexon GADNOU 27, 30 | * 18981-21848 of SEQ ID NO: 6, 7 |
| 49 | Hexon GADNOU 28, 31 | * 18981-21851 of SEQ ID NO: 8, 9 |
| 50 | Hexon GADNOU 19 | * 18981-21845 of SEQ ID NO: 10 |
| 51 | Penton GADNOU 19, 20, 21, 29, 30, 31 | * 14021-15973 of SEQ ID NO: 10, 1, 2, 5, 7, 9 |
| 52 | Penton GADNOU 25, 26, 27, 28 | * 14018-15970 of SEQ ID NO: 3, 4, 6, 8 |
| 53 | Fiber GADNOU 19, 20, 21, 29, 30, 31 | * 32163-33956 of SEQ ID NO: 10, 1, 2, 5<br>32166-33959 of SEQ ID NO: 7<br>32169-33962 of SEQ ID NO: 9 |
| 54 | Fiber GADNOU 25, 26, 27, 28 | * 32146-33951 of SEQ ID NO: 3, 4, 6, 8 |
| 55 | | VA RNA I GADNOU 19, 20, 21, 29, 30, 31 (10492-10659 of SEQ ID NO: 10, 1, 2, 5, 7, 9) |
| 56 | | VA RNA I GADNOU 25, 26, 27, 28 (10489-10656 SEQ ID NO: 3, 4, 6, 8) |
| 57 | | VA RNA II GADNOU 19, 20, 21, 29, 30, 31, 25, 26, 27, 28 (10724-10897 of SEQ ID NO: 10, 1, 2, 5, 7, 9 and 10721-10894 SEQ ID NO: 3, 4, 6, 8) |
| 58 | | FW primer GAd-GAG left end |

TABLE 1-continued

SEQ ID NOs referred to in the application

| SEQ ID NO | Polypeptide | Polynucleotide |
|---|---|---|
| 59 | | RV primer GAd-GAG left end |
| 60 | | FW primer GAd right end |
| 61 | | RV primer GAd right end |
| 62 | | FW primer pIX |
| 63 | | RV primer pIX |
| 64 | | FW primer Amp-LacZ-SacB Ex. 2 |
| 65 | | RV primer Amp-LacZ-SacB Ex. 2 |
| 66 | | FW primer Amp-LacZ-SacB Ex. 4 |
| 67 | | RV primer Amp-LacZ-SacB Ex. 4 |
| 68 | | SS oligo Amp-LacZ-SacB |
| 69 | | CMVfw |
| 70 | | CMVrv |
| 71 | | CMVFAM-TAMRA probe |
| 72 | | GADNOU19 GAG (DE1DE3) |
| 73 | | GADNOU20 GAG |
| 74 | GAG | |

The following Tables 2a and 2b provide the genomic boundaries/coordinates of CDSs, RNAs and ITRs in the GADNOU genomes. They apply to any reference to genomnic elements herein that are listed in these tables and are incorporated as preferred into the respective embodiments.

TABLE 2a

Genomic boundaries of CDSs, RNAs and ITRs for GADNOU19, GADNOU20, GANOU21, GADNOU29, GADNOU30, GADNOU31. E3_Orf2* denotes a putative open-reading frame having a GTG as initial codon. rc denotes reverse complement. Products generated by splicing are indicated by multiple coordinate pairs.

| | GADNOU | | | | | |
|---|---|---|---|---|---|---|
| ORF | 19 | 20 | 21 | 29 | 30 | 31 |
| E1A | (556 ... 1069, 1178 ... 1467) | (556 ... 1069, 1178 ... 1467) | (556 ... 1069, 1178 ... 1467) | (556 ... 1069, 1178 ... 1467) | (556 ... 1069, 1178 ... 1467) | (556 ... 1069, 1178 ... 1467) |
| E1B_SmallT_19K | 1668 ... 2210 | 1668 ... 2210 | 1668 ... 2210 | 1668 ... 2210 | 1668 ... 2210 | 1668 ... 2210 |
| E1B_LargeT_55K | 1973 ... 3472 | 1973 ... 3472 | 1973 ... 3472 | 1973 ... 3472 | 1973 ... 3472 | 1973 ... 3472 |
| E1B_IX | 3566 ... 3964 | 3566 ... 3964 | 3566 ... 3964 | 3566 ... 3964 | 3566 ... 3964 | 3566 ... 3964 |
| E2A_DBP | rc(22600 ... 24243) | rc(22600 ... 24243) | rc(22600 ... 24243) | rc(22600 ... 24243) | rc(22603 ... 24246) | rc(22606 ... 24249) |
| E2B_IVa2 | rc(4026 ... 5356, 5635 ... 5647) | rc(4026 ... 5356, 5635 ... 5647) | rc(4026 ... 5356, 5635 ... 5647) | rc(4026 ... 5356, 5635 ... 5647) | rc(4026 ... 5356, 5635 ... 5647) | rc(4026 ... 5356, 5635 ... 5647) |
| E2BPolymerase | rc(5129 ... 8707, 13976 ... 13984) | rc(5129 ... 8707, 13976 ... 13984) | rc(5129 ... 8707, 13976 ... 13984) | rc(5129 ... 8707, 13976 ... 13984) | rc(5129 ... 8707, 13976 ... 13984) | rc(5129 ... 8707, 13976 ... 13984) |
| E2B_pTP | rc(8509 ... 10461, 13976 ... 13984) | rc(8509 ... 10461, 13976 ... 13984) | rc(8509 ... 10461, 13976 ... 13984) | rc(8509 ... 10461, 13976 ... 13984) | rc(8509 ... 10461, 13976 ... 13984) | rc(8509 ... 10461, 13976 ... 13984) |
| L1_52-55KD | 10915 ... 12138 | 10915 ... 12138 | 10915 ... 12138 | 10915 ... 12138 | 10915 ... 12138 | 10915 ... 12138 |
| L1_IIIa | 12167 ... 13951 | 12167 ... 13951 | 12167 ... 13951 | 12167 ... 13951 | 12167 ... 13951 | 12167 ... 13951 |
| L2_Penton | 14021 ... 15973 | 14021 ... 15973 | 14021 ... 15973 | 14021 ... 15973 | 14021 ... 15973 | 14021 ... 15973 |
| L2_VII | 16005 ... 16610 | 16005 ... 16610 | 16005 ... 16610 | 16005 ... 16610 | 16005 ... 16610 | 16005 ... 16610 |
| L2_V | 16683 ... 17762 | 16683 ... 17762 | 16683 ... 17762 | 16683 ... 17762 | 16683 ... 17762 | 16683 ... 17762 |
| L2_X | 17794 ... 18024 | 17794 ... 18024 | 17794 ... 18024 | 17794 ... 18024 | 17794 ... 18024 | 17794 ... 18024 |
| L3_VI | 18125 ... 18874 | 18125 ... 18874 | 18125 ... 18874 | 18125 ... 18874 | 18125 ... 18874 | 18125 ... 18874 |
| L3_Hexon | 18981 ... 21845 | 18981 ... 21845 | 18981 ... 21845 | 18981 ... 21845 | 18981 ... 21848 | 18981 ... 21851 |
| L3_Endoprotease | 21873 ... 22502 | 21873 ... 22502 | 21873 ... 22502 | 21873 ... 22502 | 21876 ... 22505 | 21879 ... 22508 |
| L4_100 kD | 24287 ... 26794 | 24287 ... 26794 | 24287 ... 26794 | 24287 ... 26794 | 24290 ... 26797 | 24293 ... 26800 |
| L4_22 kD | 26478 ... 27074 | 26478 ... 27074 | 26478 ... 27074 | 26478 ... 27074 | 26481 ... 27077 | 26484 ... 27080 |
| L4_33 kD | (26478 ... 26823, 27101 ... 27384) | (26478 ... 26823, 27101 ... 27384) | (26478 ... 26823, 27101 ... 27384) | (26478 ... 26823, 27101 ... 27384) | (26481 ... 26826, 27104 ... 27387) | (26484 ... 26829, 27107 ... 27390) |
| L4_VIII | 27445 ... 28125 | 27445 ... 28125 | 27445 ... 28125 | 27445 ... 28125 | 27448 ... 28128 | 27451 ... 28131 |
| L5_Fiber | 32163 ... 33956 | 32163 ... 33956 | 32163 ... 33956 | 32163 ... 33956 | 32166 ... 33959 | 32169 ... 33962 |
| E3_Orf1 | 28129 ... 28449 | 28129 ... 28449 | 28129 ... 28449 | 28129 ... 28449 | 28132 ... 28452 | 28135 ... 28455 |
| E3_Orf2* | 28430 ... 28975 | 28430 ... 28975 | 28430 ... 28975 | 28430 ... 28975 | 28433 ... 28978 | 28436 ... 28981 |
| E3_Orf3 | 28962 ... 29165 | 28962 ... 29165 | 28962 ... 29165 | 28962 ... 29165 | 28965 ... 29168 | 28968 ... 29171 |
| E3_Orf4 | 29173 ... 29652 | 29173 ... 29652 | 29173 ... 29652 | 29173 ... 29652 | 29176 ... 29655 | 29179 ... 29658 |
| E3_Orf5 | 29699 ... 30565 | 29699 ... 30565 | 29699 ... 30565 | 29699 ... 30565 | 29702 ... 30568 | 29705 ... 30571 |
| E3_Orf6 | 30611 ... 30925 | 30611 ... 30925 | 30611 ... 30925 | 30611 ... 30925 | 30614 ... 30928 | 30617 ... 30931 |
| E3_Orf7 | 30937 ... 31206 | 30937 ... 31206 | 30937 ... 31206 | 30937 ... 31206 | 30940 ... 31209 | 30943 ... 31212 |
| E3_Orf8 | 31213 ... 31632 | 31213 ... 31632 | 31213 ... 31632 | 31213 ... 31632 | 31216 ... 31635 | 31219 ... 31638 |
| E3_Orf9 | 31628 ... 32011 | 31628 ... 32011 | 31628 ... 32011 | 31628 ... 32011 | 31631 ... 32014 | 31634 ... 32017 |
| E4_Orf6/7 | rc(34146 ... 34421, 35124 ... 35306) | rc(34146 ... 34421, 35124 ... 35306) | rc(34146 ... 34421, 35124 ... 35306) | rc(34146 ... 34421, 35124 ... 35306) | rc(34149 ... 34424, 35127 ... 35309) | rc(34152 ... 34427, 35130 ... 35312) |
| E4_Orf6 | rc(34425 ... 35306) | rc(34425 ... 35306) | rc(34425 ... 35306) | rc(34425 ... 35306) | rc(34428 ... 35309) | rc(34431 ... 35312) |
| E4_Orf4 | rc(35209 ... 35571) | rc(35209 ... 35571) | rc(35209 ... 35571) | rc(35209 ... 35571) | rc(35212 ... 35574) | rc(35215 ... 35577) |

TABLE 2a-continued

Genomic boundaries of CDSs, RNAs and ITRs for GADNOU19, GADNOU20, GANOU21, GADNOU29, GADNOU30, GADNOU31. E3_Orf2* denotes a putative open-reading frame having a GTG as initial codon. rc denotes reverse complement. Products generated by splicing are indicated by multiple coordinate pairs.

| ORF | GADNOU | | | | | |
| --- | --- | --- | --- | --- | --- | --- |
| | 19 | 20 | 21 | 29 | 30 | 31 |
| E4_Orf3 | rc(35591 ... 35941) | rc(35591 ... 35941) | rc(35591 ... 35941) | rc(35591 ... 35941) | rc(35594 ... 35944) | rc(35597 ... 35947) |
| E4_Orf2 | rc(35941 ... 36330) | rc(35941 ... 36330) | rc(35941 ... 36330) | rc(35941 ... 36330) | rc(35944 ... 36333) | rc(35947 ... 36336) |
| E4_Orf1 | rc(36368 ... 36748) | rc(36368 ... 36748) | rc(36368 ... 36748) | rc(36368 ... 36748) | rc(36371 ... 36751) | rc(36374 ... 36754) |
| VA RNA I | 10492 ... 10659 | 10492 ... 10659 | 10492 ... 10659 | 10492 ... 10659 | 10492 ... 10659 | 10492 ... 10659 |
| VA RNA II | 10724 ... 10897 | 10724 ... 10897 | 10724 ... 10897 | 10724 ... 10897 | 10724 ... 10897 | 10721 ... 10894 |
| 5prime ITR | 1 ... 83 | 1 ... 83 | 1 ... 83 | 1 ... 83 | 1 ... 83 | 1 ... 83 |
| 3prime ITR | 37102 ... 37184 | 37102 ... 37184 | 37102 ... 37184 | 37102 ... 37184 | 37105 ... 37187 | 37108 ... 37190 |

TABLE 2b

Genomic boundaries of CDSs, RNAs and ITRs for GADNOU25, GADNOU26, GANOU27, GADNOU28. E3_Orf2* denotes a putative open-reading frame having a GTG as initial codon, rc denotes reverse complement. Products generated by splicing are indicated by multiple coordinate pairs.

| ORF | GADNOU | | | |
| --- | --- | --- | --- | --- |
| | 25 | 26 | 27 | 28 |
| E1A | (545 ... 1058, 1166 ... 1455) | (545 ... 1058, 1166 ... 1455) | (545 ... 1058, 1166 ... 1455) | (545 ... 1058, 1166 ... 1455) |
| E1B_SmallT_19K | 1656 ... 2207 | 1656 ... 2207 | 1656 ... 2207 | 1656 ... 2207 |
| E1B_LargeT_55K | 1961 ... 3469 | 1961 ... 3469 | 1961 ... 3469 | 1961 ... 3469 |
| E1B_IX | 3563 ... 3961 | 3563 ... 3961 | 3563 ... 3961 | 3563 ... 3961 |
| E2A_DBP | rc(22597 ... 24240) | rc(22597 ... 24240) | rc(22600 ... 24243) | rc(22603 ... 24246) |
| E2B_IVa2 | rc(4023 ... 5353, 5632 ... 5644) | rc(4023 ... 5353, 5632 ... 5644) | rc(4023 ... 5353, 5632 ... 5644) | rc(4023 ... 5353, 5632 ... 5644) |
| E2B_Polymerase | rc(5126 ... 8704, 13972 ... 13980) | rc(5126 ... 8704, 13972 ... 13980) | rc(5126 ... 8704, 13972 ... 13980) | rc(5126 ... 8704, 13972 ... 13980) |
| E2B_pTP | rc(8506 ... 10458, 13972 ... 13980) | rc(8506 ... 10458, 13972 ... 13980) | rc(8506 ... 10458, 13972 ... 13980) | rc(8506 ... 10458, 13972 ... 13980) |
| L1_52-55KD | 10911 ... 12134 | 10911 ... 12134 | 10911 ... 12134 | 10911 ... 12134 |
| L1_IIIa | 12163 ... 13947 | 12163 ... 13947 | 12163 ... 13947 | 12163 ... 13947 |
| L2_Penton | 14018 ... 15970 | 14018 ... 15970 | 14018 ... 15970 | 14018 ... 15970 |
| L2_VII | 16002 ... 16607 | 16002 ... 16607 | 16002 ... 16607 | 16002 ... 16607 |
| L2_V | 16680 ... 17762 | 16680 ... 17762 | 16680 ... 17762 | 16680 ... 17762 |
| L2_X | 17794 ... 18024 | 17794 ... 18024 | 17794 ... 18024 | 17794 ... 18024 |
| L3_VI | 18125 ... 18874 | 18125 ... 18874 | 18125 ... 18874 | 18125 ... 18874 |
| L3_Hexon | 18981 ... 21845 | 18981 ... 21845 | 18981 ... 21848 | 18981 ... 21851 |
| L3_Endoprotease | 21870 ... 22499 | 21870 ... 22499 | 21873 ... 22502 | 21876 ... 22505 |
| L4_100kD | 24284 ... 26776 | 24284 ... 26776 | 24287 ... 26779 | 24290 ... 26782 |
| L4_22kD | 26463 ... 27056 | 26463 ... 27056 | 26466 ... 27059 | 26469 ... 27062 |
| L4_33kD | (26463 ... 26805, 27083 ... 27366) | (26463 ... 26805, 27083 ... 27366) | (26466 ... 26808, 27086 ... 27369) | (26469 ... 26811, 27089 ... 27372) |
| L4_VIII | 27427 ... 28107 | 27427 ... 28107 | 27430 ... 28110 | 27433 ... 28113 |
| L5_Fiber | 32146 ... 33951 | 32146 ... 33951 | 32149 ... 33954 | 32152 ... 33957 |
| E3_Orf1 | 28111 ... 28431 | 28111 ... 28431 | 28114 ... 28434 | 28117 ... 28437 |
| E3_Orf2* | 28412 ... 28957 | 28412 ... 28957 | 28415 ... 28960 | 28418 ... 28963 |
| E3_Orf3 | 28948 ... 29151 | 28948 ... 29151 | 28951 ... 29154 | 28954 ... 29157 |
| E3_Orf4 | 29155 ... 29634 | 29155 ... 29634 | 29158 ... 29637 | 29161 ... 29640 |
| E3_Orf3 | 29682 ... 30548 | 29682 ... 30548 | 29685 ... 30551 | 29688 ... 30554 |
| E3_Orf4 | 30594 ... 30908 | 30594 ... 30908 | 30597 ... 30911 | 30600 ... 30914 |
| E3_Orf5 | 30920 ... 31189 | 30920 ... 31189 | 30923 ... 31192 | 30926 ... 31195 |
| E3_Orf6 | 31196 ... 31615 | 31196 ... 31615 | 31199 ... 31618 | 31202 ... 31621 |
| E3_Orf7 | 31611 ... 31994 | 31611 ... 31994 | 31614 ... 31997 | 31617 ... 32000 |
| E4_Orf6/7 | rc(34142 ... 34417, 35120 ... 35302) | rc(34142 ... 34417, 35120 ... 35302) | rc(34145 ... 34420, 35123 ... 35305) | rc(34148 ... 34423, 35126 ... 35308) |
| E4_Orf6 | rc(34421 ... 35302) | rc(34421 ... 35302) | rc(34424 ... 35305) | rc(34427 ... 35308) |
| E4_Orf4 | rc(35205 ... 35567) | rc(35205 ... 35567) | rc(35208 ... 35570) | rc(35211 ... 35573) |
| E4_Orf3 | rc(35587 ... 35937) | rc(35587 ... 35937) | rc(35590 ... 35940) | rc(35593 ... 35943) |
| E4_Orf2 | rc(35937 ... 36326) | rc(35937 ... 36326) | rc(35940 ... 36329) | rc(35943 ... 36332) |
| E4_Orf1 | rc(36363 ... 36743) | rc(36363 ... 36743) | rc(36366 ... 36746) | rc(36369 ... 36749) |
| VA RNA I | 10489 ... 10656 | 10489 ... 10656 | 10489 ... 10656 | 10489 ... 10656 |
| VA RNA II | 10721 ... 10894 | 10721 ... 10894 | 10721 ... 10894 | 10721 ... 10894 |
| 5prime ITR | 1 ... 73 | 1 ... 73 | 1 ... 73 | 1 ... 73 |
| 3prime ITR | 37087 ... 37169 | 37087 ... 37169 | 37090 ... 37172 | 37093 ... 37175 |

Aspects of the Invention and Particular Embodiments Thereof

The invention relates to several aspects as set out above in the summary of the invention. These aspects comprise alternative embodiments and preferred embodiments, which are described below.

In a first aspect, the invention provides an isolated polynucleotide encoding an adenovirus hexon protein as defined in the summary of the invention above.

In a preferred embodiment, the HVR variants have at least 90%, and more preferably at least 95% sequence identity to the respective SEQ ID NO. Alternative to the definition by a percentage level of sequence identity, the HVR s can be defined to have a certain number of amino acid mutations within the respective SEQ ID NO. The number of mutations is then as follows: instead of at least 85% sequence identity, up to 4 mutations in any HVR1, up to 2 mutations in any HVR2, up to 1 mutation in any HVR3, up to 1 mutation in any HVR4, up to 2 mutations in any HVR5, up to 1 mutations in any HVR6, and up to 3 mutations in any HVR7; instead of at least 90% sequence identity, up to 2 mutations in any HVR1, up to 1 mutation in any HVR2, up to 1 mutation and preferably no mutation in any HVR3, up to 1 mutation in any HVR4, up to 1 mutation in any HVR5, up to 1 mutation and preferably no mutation in any HVR6, and up to 2 mutations in any HVR7; instead of at least 95% sequence identity, up to 1 mutation in any HVR1, up to 1 mutation and preferably no mutation in any HVR2, up to 1 mutation and preferably no mutation in any HVR3, up to 1 mutation and preferably no mutation in any HVR4, up to 1 mutation and preferably no mutation in any HVR5, up to 1 mutation and preferably no mutation in any HVR6, and up to 1 mutation in any HVR7.

As known in the art, e.g. from Bradley et al. (J Virol., 2012 January; 86(2):1267-72), adenovirus neutralizing antibodies target the hexon hypervariable regions, and by replacing the HVR regions of an adenovirus with serum-prevalence, that adenovirus can evade the immune system in the immune host. Thus, while the above HVRs can be used with the respective hexon proteins defined below, they have utility independent from those hexon proteins and also from the below penton and fiber proteins, namely by replacing the hexon HVRs in a different adenovirus having other hexon, penton and/or fiber proteins.

In a preferred embodiment, the hexon protein according to
A) comprises an amino acid sequence according to SEQ ID NO: 46, or a variant thereof having at least 85% sequence identity to SEQ ID NO: 46,
B) comprises an amino acid sequence according to SEQ ID NO: 47, or a variant thereof having at least 85% sequence identity to SEQ ID NO: 47,
C) comprises an amino acid sequence according to SEQ ID NO: 48, or a variant thereof having at least 85% sequence identity to SEQ ID NO: 48,
D) comprises an amino acid sequence according to SEQ ID NO: 49, or a variant thereof having at least 85% sequence identity to SEQ ID NO: 49, and/or
E) comprises an amino acid sequence according to SEQ ID NO: 50, or a variant thereof having at least 85% sequence identity to SEQ ID NO: 50.

In a preferred embodiment, the hexon variants have at least 90%, and preferably at least 95%, 96%, 97%, 98% or 99% sequence identity to the respective SEQ ID NO. Alternative to the definition by a percentage level of sequence identity, the hexon variants can be defined to have a certain number of amino acid mutations within the respective SEQ ID NO. The number of mutations is then as follows: instead of at least 85% sequence identity, up to 143 mutations in any hexon; instead of at least 90% sequence identity, up to 95 mutations in any hexon; instead of at least 95% sequence identity, up to 47 mutations in any hexon; instead of at least 96% sequence identity, up to 38 mutations in any hexon; instead of at least 97% sequence identity, up to 28 mutations in any hexon; instead of at least 98% sequence identity, up to 19 mutations in any hexon; instead of at least 99% sequence identity, up to 9 mutations in any hexon. It is to be understood that the hexon variants do not have less sequence identity to or more mutations in their HVRs than defined for the respective HVRs above.

In one embodiment, the isolated polynucleotide of the first aspect further encodes an adenoviral penton protein comprising an amino acid sequence according to SEQ ID NO: 51 or 52, or a variant thereof having at least 85% sequence identity to SEQ ID NO: 51 or 52. In a preferred embodiment, the penton variants have at least 90%, and preferably at least 95%, 96%, 97%, 98% or 99% sequence identity to the respective SEQ ID NO. Alternative to the definition by a percentage level of sequence identity, the penton variants can be defined to have a certain number of amino acid mutations within the respective SEQ ID NO. The number of mutations is then as follows: instead of at least 85% sequence identity, up to 97 mutations in any penton; instead of at least 90% sequence identity, up to 65 mutations in any penton; instead of at least 95% sequence identity, up to 32 mutations in any penton; instead of at least 96% sequence identity, up to 26 mutations in any penton; instead of at least 97% sequence identity, up to 19 mutations in any penton; instead of at least 98% sequence identity, up to 13 mutations in any penton; instead of at least 99% sequence identity, up to 6 mutations in any penton.

Preferably, the penton variants of SEQ ID NOs 51 and 52 each have no D and preferably a G at position 289 and no D and preferably an N at position 341. More preferably, the variant of SEQ ID NO: 52 also has no A and more preferably has a T at position 442.

In another embodiment, the isolated polynucleotide of the first aspect further (i.e. next to the hexon and possibly the penton protein) encodes an adenoviral fiber protein comprising an amino acid sequence according to SEQ ID NO: 53 or 54, or a variant thereof having at least 85% sequence identity to SEQ ID NO: 53 or 54. In a preferred embodiment, the fiber variants have at least 90%, and preferably at least 95%, 96%, 97%, 98% or 99% sequence identity to the respective SEQ ID NO. Alternative to the definition by a percentage level of sequence identity, the fiber variants can be defined to have a certain number of amino acid mutations within the respective SEQ ID NO. The number of mutations is then as follows: instead of at least 85% sequence identity, up to 89 mutations in any fiber; instead of at least 90% sequence identity, up to 59 mutations in any fiber; instead of at least 95% sequence identity, up to 29 mutations in any fiber; instead of at least 96% sequence identity, up to 23 mutations in any fiber; instead of at least 97% sequence identity, up to 17 mutations in any fiber; instead of at least 98% sequence identity, up to 11 mutations in any fiber; instead of at least 99% sequence identity, up to 5 mutations in any fiber.

Preferably, the fiber variants of SEQ ID NO: 53 have no A and preferably a P at position 181, no V and preferably an I at position 474, and/or no insertion of an S and preferably no amino acid insertion between positions 4 and 5. Preferably, the fiber variants of SEQ ID NO: 54 have no T and preferably an I at position 90, and/or an S at position 7 (preferably an S at each of positions 4-7).

In another embodiment, the isolated polynucleotide of the first aspect further (i.e. next to the hexon and possibly the penton and/or fiber protein) encodes a VA RNA II non-coding RNA comprising a nucleotide sequence according to SEQ ID NO: 57, or a variant thereof having at least 85% sequence identity to SEQ ID NO: 57. Alternatively or in addition, it may encode a VA RNA I non-coding RNA comprising a nucleotide sequence according to SEQ ID NO: 55 or 56, or a variant thereof having at least 85% sequence identity to SEQ ID NO: 55 or 56, respectively. In a preferred embodiment, the VA RNA variants have at least 90%, and preferably at least 95%, 96%, 97%, 98% or 99% sequence identity to the respective SEQ ID NO. Alternative to the definition by a percentage level of sequence identity, the VA RNA variants can be defined to have a certain number of nucleotide mutations within the respective SEQ ID NO. The number of mutations is then as follows: instead of at least 85% sequence identity, up to 25 mutations in VA RNA I and up to 26 mutations in VA RNA II; instead of at least 90% sequence identity, up to 16 mutations in VA RNA I and up to 17 mutations in VA RNA II; instead of at least 95% sequence identity, up to 8 mutations in any VA RNA; instead of at least 96% sequence identity, up to 6 mutations in any VA RNA; instead of at least 97% sequence identity, up to 5 mutations in any VA RNA; instead of at least 98% sequence identity, up to 3 mutations in any VA RNA; instead of at least 99% sequence identity, up to 1 mutation in any VA RNA.

Preferably, the VA RNA II variant of SEQ ID NO: 57 has (a) no C at position 79 and/or no A at position 80, and preferably a T at position 79 and/or a G at position 80, and (b) no A at position 81, and preferably a G at position 81. The VA RNA I variant of SEQ ID NO: 55 preferably has no G at position 80 and preferably has an A at position 80.

A VA RNA according to the invention leads to an improved adenovirus or adenovirus-like particle production as shown in Example 5.

It is preferred that the polynucleotide of the first aspect further comprises other adenoviral genes and nucleotide segments, which are adjacent to the hexon, penton and/or fiber gene in the adenovirus genome, using SEQ ID NOs 1-10 as a reference. It is particularly preferred that the polynucleotide also comprises sequences required for packaging of the polynucleotide into an adenoviral particle.

Generally, it is preferred that the isolated polynucleotide of the first aspect comprises at least one of the following:
(a) an adenoviral 5'-end, preferably an adenoviral 5' inverted terminal repeat;
(b) an adenoviral Ela region, or a fragment thereof selected from among the 13S, 12S and 9S regions;
(c) an adenoviral E1b region, or a fragment thereof selected from among the group consisting of the small T, large T and IX regions;
(d) an adenoviral VA RNA region; or a fragment thereof selected from among the group consisting of the VA RNA I and VA RNA II regions;
(e) an adenoviral E2b region; or a fragment thereof selected from among the group consisting of the small pTP, Polymerase and IVa2 regions;
(f) an adenoviral L1 region, or a fragment thereof, said fragment encoding an adenoviral protein selected from the group consisting of the 28.1 kD protein, polymerase, agnoprotein, 52/55 kDa protein, and IIIa protein;
(g) an adenoviral L2 region, or a fragment thereof, said fragment encoding an adenoviral protein selected from the group consisting of the penton protein as defined above, VII, V, and X protein;
(h) an adenoviral L3 region, or a fragment thereof, said fragment encoding an adenoviral protein selected from the group consisting of the VI protein, hexon protein as defined above, and endoprotease;
(i) an adenoviral E2a region, or a fragment thereof, said fragment encoding an adenoviral protein consisting of the DBP protein;
(j) an adenoviral L4 region, or a fragment thereof said fragment encoding an adenoviral protein selected from the group consisting of the 100 kD protein, the 22 kD homolog, the 33 kD homolog, and protein VIII;
(k) an adenoviral E3 region, or a fragment thereof selected from the group consisting of E3 ORF1, E3 ORF2, E3 ORF3, E3 ORF4, E3 ORF5, E3 ORF6, E3 ORF7, E3 ORF8 and E3 ORF9;
(l) an adenoviral L5 region, or a fragment thereof said fragment encoding the fiber protein as defined above;
(m) an adenoviral E4 region, or a fragment thereof selected from the group consisting of E4 ORF6/7, E4 ORF6, E4 ORF5, E4 ORF4, E4 ORF3, E4 ORF2, and E4 ORF1; and/or
(n) an adenoviral Y-end, preferably an adenoviral 3' inverted terminal repeat.

These elements can be from the same adenovirus as the HVRs and/or hexon of the polynucleotide of the first aspect according to Table 1 (i.e. from the same GADNOU), or from a different adenovirus, in particular from one of a different species, e.g. a human adenovirus, to form a chimeric adenovirus.

In some embodiments of the aforementioned polynucleotide it may be desirable that the polynucleotide does not comprise one or more genomic regions as outlined above (as in (a) to (m), such as e.g. region E3 and/or E4) and/or comprises an adenoviral gene which comprises a deletion and/or mutation which renders the at least one gene non-functional. In these preferred embodiments, the suitable adenoviral regions is modified to not include the aforementioned region(s)/gene(s) or to render the selected region(s)/gene(s) non-functional. One possibility to render them non-functional is to introduce one or more artificial stop-codons (e.g. TAA) into the open reading frame of these genes. Methods of rendering the virus replication-defective are well known in the art (see e.g. Brody et al, 1994 Ann NY Acad Sci., 716: 90-101). A deletion can make space to insert transgenes, preferably within an expression cassette, such as a minigene cassette as described herein. Furthermore, deletions can be used to generate adenoviral vectors which are incapable to replicate without the use of a packaging cell line or a helper virus as is well known in the art. Thus, a final recombinant adenovirus comprising a polynucleotide as outlined above which comprises one or more of the specified gene/region deletions or loss-of-function mutations can provide a safer recombinant adenovirus for e.g. gene therapy or vaccination.

While the polynucleotide may not comprise at least one genomic region/gene as outlined herein (such as e.g. region E3 and/or E4), specifically E1A, E1B, E2A, E2B, E3 ORF1, E3 ORF2, E3 ORF3, E3 ORF4, E3 ORF5, E3 ORF6, E3 ORF7, E3 ORF8, E3 ORF9, E4 ORF6/7, E4 ORF6, E4 ORF5, E4 ORF4, E4 ORF3, E4 ORF2 and/or E4 ORF1, preferably E1A, E1B, E2A, E2B, E3 and/or E4, and/or comprises an adenoviral gene which comprises a deletion and/or mutation which renders the at least one gene non-functional, it is desirable to retain an intact Ela and/or E1b region. Such an intact E1 region may be located in its native location in the adenoviral genome or placed in the site of a deletion in the native adenoviral genome (e.g., in the E3 region).

In a preferred embodiment, the isolated polynucleotide of the first aspect further encodes one or more, preferably all of the following adenoviral proteins: protein VI, protein VIII, protein IX, protein IIIa and protein IVa2.

An average person skilled in the art of adenoviruses is well aware of how to determine the open reading frames that encode for the above-specified adenoviral proteins. He is also aware of the structure of adenoviral genomes and can map, without undue burden, the individual adenoviral regions and ORFs outlined herein to any adenoviral genome.

In another embodiment, the isolated polynucleotide of the first aspect further encodes one or more heterologous proteins or fragments thereof. The one or more heterologous proteins or fragments thereof are preferably non-adenoviral proteins or fragments thereof. In a preferred embodiment, the one or more non-adenoviral proteins or fragments thereof are one or more antigenic proteins or fragments thereof. Preferably, the one or more heterologous proteins or fragments thereof are part of one or more expression cassettes. Sequences encoding for a heterologous protein and preferably an expression cassette comprising such sequence (s) encoding for a heterologous protein may be inserted into e.g. deleted regions of an adenoviral genome defined herein. An exemplary heterologous protein is the polypeptide according to SEQ ID NO: 74 or variant thereof having at least 85% sequence identity to SEQ ID NO: 74.

In a second aspect, the invention provides an isolated polynucleotide which encodes an adenovirus, which comprises a polynucleotide of the first aspect, preferably comprising an adenoviral genome according to any one of SEQ ID NOs 1-10, or a variant thereof having at least 85% sequence identity to SEQ ID NOs 1-10, respectively.

In a preferred embodiment, it encodes a replication-incompetent adenovirus, preferably comprising an adenoviral genome according to any one of SEQ ID NOs 1-10 that lacks one or more of the genomic regions/genes E1A, E1B, E2A, E2B, E3 and E4.

Most preferably, it encodes a recombinant adenovirus, preferably comprising an adenoviral genome according to any one of SEQ ID NOs 1-10, or a variant thereof having at least 85% sequence identity to SEQ ID NOs 1-10, respectively, preferably into which the one or more heterologous proteins or fragments thereof are inserted (carrier adenovirus). Preferably, the one or more heterologous proteins or fragments thereof are inserted by replacing one or more of the genomic regions/genes E1A, E1B, E2A, E2B, E3 ORF1, E3 ORF2, E3 ORF3, E3 ORF4, E3 ORF5, E3 ORF6, E3 ORF7, E3 ORF8, E3 ORF9, E4 ORF6/7, E4 ORF6, E4 ORF5, E4 ORF4, E4 ORF3, E4 ORF2 and E4 ORF1, more preferably E1, E3 and/or E4. The heterologous proteins or fragments thereof are preferably inserted as part of an expression cassette. Optionally, the carrier adenovirus is also replication-incompetent as described herein, i.e. lacking one or more of the genomic regions/genes E1A, E1B, E2A, E2B, E3 and E4.

In an exemplary embodiment, the invention provides an isolated polynucleotide which encodes an adenovirus, which comprises a polynucleotide according to SEQ ID NO 72 or 73, or a variant thereof having at least 85% sequence identity to SEQ ID NO 72 or 73, respectively.

In a preferred embodiment, the adenoviral genome variants have, instead of at least 85%, at least 90%, and preferably at least 95%, 96%, 97%, 98%, 99%, 99.5 or 99.9% sequence identity to the respective SEQ ID NO 1, least 90%, and preferably at least 95%, 96%, 97%, 98%, 99%, 99.5 or 99.9% sequence identity to SEQ ID NO 2, least 90%, and preferably at least 95%, 96%, 97%, 98%, 99%, 99.5 or 99.9% sequence identity to SEQ ID NO 3, least 90%, and preferably at least 95%, 96%, 97%, 98%, 99%, 99.5 or 99.9% sequence identity to the respective SEQ ID NO 4, least 90%, and preferably at least 95%, 96%, 97%, 98%, 99%, 99.5 or 99.9% sequence identity to the respective SEQ ID NO 5, least 90%, and preferably at least 95%, 96%, 97%, 98%, 99%, 99.5 or 99.9% sequence identity to the respective SEQ ID NO 6, least 90%, and preferably at least 95%, 96%, 97%, 98%, 99%, 99.5 or 99.9% sequence identity to the respective SEQ ID NO 7, least 90%, and preferably at least 95%, 96%, 97%, 98%, 99%, 99.5 or 99.9% sequence identity to the respective SEQ ID NO 8, least 90%, and preferably at least 95%, 96%, 97%, 98%, 99%, 99.5 or 99.9% sequence identity to the respective SEQ ID NO 9, or least 90%, and preferably at least 95%, 96%, 97%, 98%, 99%, 99.5 or 99.9% sequence identity to the respective SEQ ID NO 10, (in each case taking into account deletions as defined above).

In one embodiment, the isolated polynucleotide of the second aspect encodes a recombinant adenovirus, wherein at least one adenoviral genomic region of the recombinant adenovirus is derived from an adenovirus not comprising hexon HVRs or a hexon protein as defined above (chimeric adenovirus). Preferably, the chimeric adenovirus is chimeric mainly or preferably only for a hexon HVR or hexon protein and optionally also a penton and/or fiber protein as defined herein. In other words, the polynucleotide encodes the hexon HVRs or the hexon protein as defined above and optionally also for the penton and/or fiber protein as defined above, but one or more, preferably all other genomic regions are derived from a different adenovirus, in particular different from an adenovirus according to SEQ ID NOs 1-10. The different adenovirus is preferably one naturally found in a different host, more preferably a human adenovirus. This polynucleotide preferably encodes also for one or more heterologous non-adenoviral proteins or fragments thereof as defined above. Thus, one or more heterologous non-adenoviral genes are inserted into the adenoviral genome of the chimeric adenovirus. Accordingly, the adenoviral genome of the chimeric adenovirus is, except the DNA encoding the hexon HVRs or the hexon protein as defined above and optionally the DNA encoding the penton and/or fibre proteins as defined above, derived from a non-simian adenovirus, e.g. a human adenovirus, preferably a carrier non-simian, e.g. human, adenovirus.

It is generally preferred that the adenovirus is replication-incompetent. To this end, it is preferred that the adenovirus lacks one or more of the genomic regions E1A, E1B, E2A, E2B, E3 and E4 or comprises a deletion and/or mutation therein which renders the genomic region or an expression product encoded by it non-functional.

In one particularly preferred embodiment, the isolated polynucleotide of the first or second aspect, in all its variants described herein, may have a functionally impaired IVa2 gene, preferably a deletion of or a null-mutation in it. This gene is involved in viral DNA packing and its impairment leads to the production of virus-like particles. In this embodiment, the isolated polynucleotide of the first or second aspect preferably encodes one or more non-adenoviral B-cell epitopes and/or T-cell epitopes.

In a third aspect, the invention provides at least one isolated adenoviral capsid polypeptide encoded by a polynucleotide of the first or second aspect. The at least one isolated adenoviral capsid polypeptide comprises at least a hexon with the HVRs as defined in above, preferably the hexon protein defined above, and optionally also the penton and/or fiber protein defined above.

The least one isolated adenoviral capsid polypeptide can be obtained by expression in a cell. The expressed polypeptide(s) can be optionally purified using standard techniques. For example, the cells may be lysed either mechanically or by osmotic shock before being subject to precipitation and chromatography steps, the nature and sequence of which will depend on the particular recombinant material to be recovered. Alternatively, the expressed polypeptide(s) may be secreted and recovered from the culture medium in which the recombinant cells had been cultured as is known in the art of protein expression.

In a fourth aspect, the invention provides an adenovirus (also termed adenovirus vector or adenoviral vector herein) comprising the isolated polynucleotide of the first or second aspect and/or the adenoviral capsid polypeptides of the third aspect. Accordingly, the adenovirus can be, for example, an adenovirus encoded by any one of SEQ ID NOs 1-10 or a recombinant adenovirus, such as a carrier or a chimeric adenovirus as defined above. Preferably, the adenovirus is an isolated adenovirus.

In an exemplary embodiment, the invention provides an adenovirus comprising a polynucleotide according to SEQ ID NO 72 or 73, or a variant thereof having at least 85% sequence identity to SEQ ID NO 72 or 73, respectively.

The adenovirus may or may not comprise a polynucleotide of the first or second aspect. In case this polynucleotide is not comprised in the adenovirus, it is preferred that it is provided in trans (i.e. by a genetic element that is not the adenovirus genome incorporated into the adenovirus). It is usually provided by a helper construct (e.g. a plasmid or virus) or by the genome of or a helper construct in a packaging host cell (complementing cell as described herein). It is further preferred that polynucleotides provided in trans are not comprised in the genome incorporated in the adenovirus, including homologs or other sequence variants of these polynucleotides. For example, if the polynucleotide provided in trans comprises a hexon, penton and/or fiber gene, the genome incorporated into the adenovirus does not comprise any polynucleotide encoding for a hexon, penton and/or fiber protein, respectively. Most preferably, the polynucleotide provided in trans encodes at least one adenoviral capsid polypeptide as defined in the third aspect, i.e. a hexon with the HVRs as defined in the first or second aspect, preferably the hexon protein as defined in the first or second aspect, and optionally also the penton and/or fiber protein as defined in the first or second aspect.

In the construction of adenovirus vectors for delivery of a gene to a host, e.g. a human or other mammalian cell, a range of adenovirus nucleic acid sequences can be employed. For example, all or a portion of the adenovirus delayed early gene E3 may be eliminated from the adenovirus sequence which forms a part of the recombinant virus. The function of simian E3 is believed to be irrelevant to the function and production of the recombinant virus particle. In some embodiments, adenovirus vectors may also be constructed having a deletion of at least the ORF6 region of the E4 gene, and more desirably because of the redundancy in the function of this region, the entire E4 region. Still another vector of this invention contains a deletion in the delayed early gene E2a. Deletions may also be made in any of the late genes L1 through L5 of the simian adenovirus genome. Similarly, deletions in the intermediate genes IX and IVa2 may be useful for some purposes. Other deletions may be made in the other structural or non-structural adenovirus genes. The above discussed deletions may be used individually, i. e., an adenovirus sequence for use in the present invention may contain deletions in only a single region. Alternatively, deletions of entire genes or portions thereof effective to destroy their biological activity may be used in any combination. For example, the adenovirus sequence may have deletions of the E1 and the E4 region, or of the E1, E2a and E3 region, or of the E1 and E3 regions, or of E1, E2a and E4 regions, with or without deletion of E3, and so on. Such deletions may be used in combination with other adenoviral gene mutations, such as temperature-sensitive mutations, to achieve a desired result.

An adenoviral vector lacking any essential adenoviral sequences (e.g., a region selected from E1a, E1b, E2a, E2b, E4 ORF6, L1 or L4) may be cultured in the presence of the missing adenoviral gene products which are required for viral infectivity and propagation of an adenoviral particle. These helper functions may be provided by culturing the adenoviral vector in the presence of one or more helper constructs (e.g. a plasmid or virus) or a packaging host cell (complementing cell as described herein). See, for example, the techniques described for preparation of a "minimal" human adenovirus vector in WO96/13597).

Useful helper constructs contain selected adenovirus gene sequences that complement the respective genes that are deleted and/or that are not expressed by the vector and the cell in which the vector is transfected. In one embodiment, the helper construct is replication-defective and contains essential and optionally further adenovirus genes.

Helper constructs may also be formed into poly-cation conjugates as described in Wu et al, J. Biol. Chem., 264: 16985-16987 (1989); K. J. Fisher and J. M. Wilson, Biochem. J., 299: 49 (Apr. 1, 1994). A helper construct may optionally contain a reporter gene. A number of such reporter genes are known to the art. The presence of a reporter gene on the helper construct which is different from the transgene on the adenovirus vector allows both the adenovirus and the helper construct to be independently monitored. This second reporter may be used to facilitate separation between the resulting recombinant adenovirus and the helper construct upon purification. A preferred helper construct is a helper virus.

To generate recombinant adenoviruses (Ad) deleted in any of the genes described in the context of preferred embodiments herein, the function of the deleted gene region, if essential to the replication and infectivity of the virus, is preferably supplied to the recombinant virus by a helper construct or cell, i.e. a complementation or packaging cell. In many circumstances, a construct/cell expressing the human E1 can be used to transcomplement the vector used to generate recombinant adenoviruses. This is particularly advantageous because, due to the diversity between the polynucleotide sequences of the invention and the human adenoviral E1 sequences found in currently available packaging construct/cells, the use of the current human E1-containing constructs/cells will prevent the generation of replication-competent adenoviruses during the replication and production process. However, in certain circumstances, it will be desirable to utilize a construct/cell which expresses the E1 gene products for the production of an E1-deleted recombinant adenovirus.

If desired, one may utilize the sequences provided herein to generate a helper construct/cell or cell line that expresses, at a minimum, the adenovirus E1 gene from an adenovirus according to any one of SEQ ID NOS 1-10 under the transcriptional control of a promoter for expression in a selected parent cell line, such as e.g. a HeLa cell. Inducible or constitutive promoters may be employed for this purpose. Examples of promoters are provided e.g. in the examples described herein. Such E1-expressing cells are useful in the generation of recombinant adenovirus E1 deleted vectors. Additionally, or alternatively, the invention provides constructs/cells that express one or more adenoviral gene products, e.g., E1a, E1b, E2a, and/or E4 ORF6, preferably Ad5 E4 ORF6, which can be constructed using essentially the same procedures for use in the generation of recombinant adenoviral vectors. Such constructs/cells can be utilized to transcomplement adenovirus vectors deleted in essential genes that encode those products, or to provide helper functions necessary for packaging of a helper-dependent virus (e. g., adeno-associated virus).

Generally, when delivering an adenovirus vector by transfection, the vector is delivered in an amount from about 0.1 µg to about 100 µg DNA, and preferably about 10 to about 50 µg DNA to about $1\times10^4$ cells to about $1\times10^3$ cells, and preferably about $10^5$ cells. However, the relative amounts of vector DNA to host cells may be adjusted, taking into consideration such factors as the selected vector, the delivery method and the host cells selected. Introduction of the vector into a host cell may be achieved by any means known in the art or as disclosed herein, including transfection, and infection, e.g. using $CaPO_4$ transfection or electroporation.

For the construction and assembly of the desired recombinant adenovirus, the adenovirus vector can in one example be transfected in vitro in the presence of a helper construct into the packaging cell line, allowing homologous recombination to occur between the helper and the adenovirus vector sequences, which permits the adenovirus-transgene sequences in the vector to be replicated and packaged into virion capsids, resulting in the recombinant viral vector particles as is well known in the art. A recombinant adenovirus of the invention is useful e.g. in transferring a selected transgene into a selected host cell.

In a preferred embodiment, the adenovirus of the fourth aspect has a seroprevalence in less than 5% of human subjects and preferably no seroprevalence in human subjects, most preferably no seroprevalence in human subjects that have not previously been in contact with a non human great apes adenovirus, more preferably with one or more, particularly all adenoviruses according to SEQ ID NOs 1-10. In this context it is preferred that the human subjects belong to an ethnic group selected from Europeans, indigenous people of Africa, Asians, indigenous people of America and indigenous people of Oceania. Methods for the identification of the ethnic origin of a human subject are comprised in the art (see e.g. WO2003/102236).

In a further preferred embodiment of a recombinant adenovirus, the adenovirus DNA is capable of entering a mammalian target cell, i.e. it is infectious. An infectious recombinant adenoviruses of the invention can be used as a vaccine and for gene therapy as also described herein. Thus, in another embodiment it is preferred that the recombinant adenovirus comprises a molecule for delivery into a target cell. Preferably, the target cell is a mammalian cell, e.g. a non human great apes cell, a rodent cell or a human cell. For example, the molecule for delivery into a target cell can be a polynucleotide encoding for a heterologous protein (i.e. a heterologous gene) as defined herein, preferably within an expression cassette. Methods to introduce an expression cassette into the genome of an adenovirus are well known in the art. In one example a recombinant adenovirus of the present invention that comprises an expression cassette, encoding e.g. a heterologous gene, can be generated by replacing a genomic region of the adenovirus selected from E1A, E1B, E2A, E2B, E3 and E4 with said expression cassette. The genomic regions E1A, E1B, E2A, E2B, E3 and E4 of the adenoviruses of the invention can easily be identified by an alignment with known and annotated adenoviral genomes such as from human Ad5 (see: Birgitt Tauber and Thomas Dobner, Oncogene (2001) 20, p. 7847-7854; and also: Andrew J. Davison, et al., "Genetic content and evolution of adenoviruses", Journal of General Virology (2003), 84, p. 2895-2908).

The molecule for delivery into a target cell is preferably a heterologous polynucleotide but may also be a polypeptide or a small chemical compound, preferably having a therapeutic or diagnostic activity. In one particularly preferred embodiment, the molecule for delivery into a target cell is a heterologous polynucleotide that comprises an adenovirus 5' inverted terminal repeat sequence (ITR) and a 3' ITR. It will be evident to the skilled person that the molecular size of the molecule has to be chosen such that the capsid can form around and package the molecule, when the recombinant adenovirus is produced, e.g. in a packaging cell. Thus, preferably the heterologous gene is a minigene which can have e.g. up to 7000 and maximally up to 8000 base pairs.

In a fifth aspect, the invention provides a virus-like particle (VLP) encoded by a polynucleotide of the first or second aspect. Accordingly, the VLP comprises at least one isolated adenoviral capsid polypeptide according to the third aspect. In one embodiment, the polynucleotide encoding the VLP has the Iva2 gene deleted or has a null-mutation in the Iva2 gene.

According to the definition of VLPs below, the VLP of the fifth aspect comprises substantially no viral genomic DNA. VLPs, including adenovirus VLPs, have been used for vaccination, gene therapy or for direct drug delivery, e.g. of anti-cancer drugs (Chroboczek et al., ACTA ABP BIOCHIMICA POLONICA, Vol. 61, No. 3/2014). Accordingly, the VLP of the fifth aspect may comprises one or more non-adenoviral B-cell and/or non-adenoviral T-cell epitopes, one or more non-adenoviral genes for gene therapy, and/or one or more pharmaceutical agents, e.g. anti-cancer agents. In one embodiment, the VLP incorporates, preferably presents one or more non-adenoviral B-cell epitopes and/or incorporates one or more non-adenoviral T-cell epitopes.

In a sixth aspect, the invention provides a vector comprising a polynucleotide of the first or second aspect. In a preferred embodiment, the vector is a plasmid vector, e.g. an expression vector. A plasmid vector can advantageously be used to generate a recombinant adenovirus as described herein. As the sequence information of the novel hexon, penton and fiber proteins and the VA RNAs of the invention are provided, said recombinant adenovirus is obtainable e.g. by constructing a recombinant adenovirus which is encoded by the polynucleotide of the first or second aspect and any other adenoviral genomic region. Methods for the construction of recombinant adenoviruses are well known in the art. Useful techniques for the preparation of recombinant adenoviruses are, for example, reviewed in Graham & Prevec, 1991 In Methods in Molecular Biology: Gene Transfer and Expression Protocols, (Ed. Murray, E J.), p. 109; and Hitt et al., 1997 "Human Adenovirus Vectors for Gene Transfer into Mammalian Cells" Advances in Pharmacology 40:137-206. Further methods are described in WO 2006/086284.

In order to express a polynucleotide of the first or second aspect, one can subclone said polynucleotide into an expression vector that contains a strong promoter to direct transcription, preferably with an expression cassette. Suitable bacterial promoters are well known in the art, e.g., *E. coli*, *Bacillus* sp., and *Salmonella*, and kits for such expression systems are commercially available. Similarly eukaryotic expression systems for mammalian cells, yeast, and insect cells are well known in the art and are also commercially available. See below for further details of expression cassettes.

The particular expression vector useful for transporting the genetic information into the cell is not particularly critical. Any of the conventional vectors used for expression in eukaryotic or prokaryotic cells may be used. Standard bacterial expression vectors include plasmids such as pBR322 based plasmids, pSKF, pET23D, and fusion expression systems such as GST and LacZ, but there are many more known in the art to the skilled person that can be usefully employed. Expression vectors containing regulatory elements from eukaryotic viruses are typically used in eukaryotic expression vectors, e.g. SV40 vectors, papilloma virus vectors, and vectors derived from Epstein-Barr virus. Other exemplary eukaryotic vectors include pMSG, pAV009/A.sup.+, pMTO10/A.sup.+, pMAMneo-5, baculovirus pDSVE, pcDNA3.1, pIRES and any other vector allowing expression of proteins under the direction of e.g. the HCMV immediate-early promoter, SV40 early promoter, SV40 late promoter, metallothionein promoter, murine mammary tumor virus promoter, Rous sarcoma virus promoter, polyhedrin promoter, or other promoters shown effective for expression in eukaryotic cells. Some expression systems have markers that provide gene amplification such as thymidine kinase, hygromycin B phosphotransferase, and dihydrofolate reductase. Alternatively, high yield expression systems not involving gene amplification are also suitable. The elements that may also be included in expression vectors include a replicon that functions in *E. coli*, a gene encoding drug resistance to permit selection of bacteria that harbor recombinant plasmids, and unique restriction sites in nonessential regions of the plasmid to allow insertion of eukaryotic sequences. The particular drug resistance gene chosen is not critical—any of the many drug resistance genes known in the art are suitable. The prokaryotic sequences are optionally chosen such that they do not interfere with the replication of the DNA in eukaryotic cells, if necessary.

In a seventh aspect, the invention provides a composition comprising (i) an adjuvant, (ii) an isolated polynucleotide of the first or second aspect, at least one isolated adenoviral capsid polypeptide of the third aspect, the adenovirus of the fourth aspect, a virus-like particle of the fifth aspect, or a vector of the sixth aspect, and optionally (iii) a pharmaceutically acceptable excipient. Preferably, the adjuvant is an agonist for a receptor selected from the group consisting of type I cytokine receptors, type II cytokine receptors, TNF receptors, vitamin D receptor acting as transcription factor, and the Toll-like receptors 1 (TLR1), TLR-2, TLR 3, TLR4, TLR5, TLR-6, TLR7 and TLR9.

A composition that comprises an adjuvant can be used as a vaccine, e.g. for human subjects. For instance, activation of specific receptors can stimulate an immune response. Such receptors are known to the skilled artisan and comprise, for example, cytokine receptors, in particular type I cytokine receptors, type II cytokine receptors, TNF receptors; and vitamin D receptor acting as transcription factor; and the Toll-like receptors 1 (TLR1), TLR-2, TLR 3, TLR4, TLR5, TLR-6, TLR7, and TLR9. Agonists to such receptors have adjuvant activity, i.e., are immunostimulatory. In a preferred embodiment, the adjuvant of the composition may be one or more Toll-like receptor agonists. In a more preferred embodiment, the adjuvant is a Toll-like receptor 4 agonist. In a particular preferred embodiment, the adjuvant is a Toll-like receptor 9 agonist. For adjuvant examples, see below. Also, preferred pharmaceutically acceptable excipients are mentioned below.

In an eighth aspect, the invention provides a cell comprising a polynucleotide of the first or second aspect, at least one isolated adenoviral capsid polypeptide of the third aspect, the adenovirus of the fourth aspect, a virus-like particle of the fifth aspect, or a vector of the sixth aspect.

Preferably, the cell is a host cell that expresses at least one adenoviral gene, or preferably all adenoviral genes, that is/are deleted or rendered non-functional as explained above to render the adenovirus replication-incompetent. By expression of this at least one genes, the host cell preferably enables replication of the otherwise replication-incompetent adenovirus. In one embodiment, the host cell that expresses at least one adenoviral gene selected from the group consisting of E1A, E1B, E2A, E2B, E3 and E4. In particular, this at least one adenoviral gene is deleted or rendered non-functional in the adenoviral genome. Such a complement cell can be used for the propagation and rescue of adenoviruses that are replication-incompetent, because they lack e.g. one of the aforementioned gene products.

The cell may be selected of a bacterial cell such as an *E. coli* cell, a yeast cell such as *Saccharomyces cerevisiae* or *Pichia pastoris*, a plant cell, an insect cell such as SF9 or Hi5 cells, or a mammalian cell. Preferred examples of mammalian cells are Chinese hamster ovary (CHO) cells, human embryonic kidney (HEK 293) cells, HELA cells, human hepatoma cells (e.g. Huh7.5), Hep G2 human hepatoma cells, Hep 3B human hepatoma cells and the like.

If the cell comprises a polyucleotide according to the first or second aspect, this polynucleotide may be present in the cell either (i) freely dispersed as such, or (ii) integrated into the cell genome or mitochondrial DNA.

In a further preferred embodiment, the cell is a host cell, preferably a 293 cell or a PER.C6™ cell, that expresses at least one adenoviral gene selected from the group consisting of E1a, E1b, E2a, E2b, E4, L1, L2, L3, L4 and L5.

Standard transfection methods can be used to produce bacterial, mammalian, yeast or insect cell lines. Any of the well-known procedures for introducing foreign polynucleotide sequences into host cells may be used. For example, commercially available liposome-based transfection kits such as Lipofectamine™ (Invitrogen), commercially available lipid-based transfection kits such as Fugene (Roche Diagnostics), polyethylene glycol-based transfection, calcium phosphate precipitation, gene gun (biolistic), electroporation, or viral infection and any of the other well known methods for introducing cloned genomic DNA, cDNA, synthetic DNA or other foreign genetic material into a host cell may be used. It is only necessary that the particular genetic engineering procedure used be capable of successfully introducing at least one gene into the host cell capable of expressing the receptor.

Further embodiments of the cell are described with respect to the fourth aspect of the invention above.

In a ninth aspect, the invention provides a polynucleotide of the first or second aspect, at least one isolated adenoviral capsid polypeptide of the third aspect, the adenovirus of the fourth aspect, a virus-like particle of the fifth aspect, or a vector of the sixth aspect and/or the composition of the seventh aspect for use in treating or preventing a disease. In one embodiment, the treating or preventing is by vaccination. In another embodiment, the treating is by gene therapy. With respect to vaccination, the disease is an infectious disease, preferably caused by a pathogen as described herein, or a non-infectious disease, preferably characterized by diseased cells that express antigens not expressed by healthy cells (such as tumor cells expressing tumor-associated antigens). With respect to gene therapy, the disease is an inheritable disease caused by one or more somatic mutations leading to a loss or gain of function of a gene or protein.

It is well-known that adenoviruses are useful in gene-therapy and as vaccines. Preclinical and clinical studies have demonstrated the feasibility of vector design, robust antigen expression and protective immunity using this system. Tus, a preferred embodiment of the use is in vaccination, e.g. for human subjects. Detailed instructions of how adenoviruses are used and prepared for vaccination are provided as ample literature comprised in the art and known to the skilled person. Viral vectors based e.g. on a non human great apes adenovirus represent an alternative to the use of human derived Ad vectors for the development of genetic vaccines (Farina S F, J Virol. 2001 December; 75(23):11603-13; Fattori E, Gene Ther. 2006 July; 13(14):1088-96). Adenoviruses isolated from non human great apes are closely related to adenoviruses isolated from humans as demonstrated by their efficient propagation in cells of human origin. However, since human and non human apes adenoviruses are related, there may be some degree of or no serologic cross reactivity between the two virus species. This presumption has been confirmed when chimpanzee adenoviruses were isolated and characterized. Thus, a non human great apes adenovirus according to the invention provides a basis for reducing the adverse effects associated with the preexisting immunity in humans to common serotypes of human adenoviruses, and thereby a valuable medical tool that can e.g. be used for immunization and/or gene therapy.

This is due to the novel sequences of adenovirus capsid proteins including hexon, penton and fiber protein, but in particular novel hexon HVR sequences that represent the most surface exposed adenovirus epitopes. Accordingly, no or very few neutralizing antibodies specific for the capsid proteins and in particular the hexon HVRs according to the invention are expected to be present in human blood sera. Thus, one advantage of the novel sequences is that they can be used to enhance prior art adenoviruses, which have been engineered for e.g. medical purposes. For example, the sequences can be used to e.g. replace/substitute one or more of the major structural capsid proteins or in particular only the hexon HVRs of a different adenovirus, e.g. a prior art adenovirus, to obtain improved recombinant adenoviruses with a reduced seroprevalence in humans (chimeric adenoviruses). As the novel sequences and therefore adenoviruses which have been re-engineered as described will not encounter any significant inhibitory immune response in humans when administered, their overall transduction efficiency and infectivity will be enhanced. Thus, such improved adenoviruses are expected to be more effective vaccines as the entry into host cells and the expression of antigens will not be hampered by any significant titer of neutralizing antibodies.

It is preferred that the vaccine comprises an adjuvant. Preferred immunological adjuvants are mentioned herein and can be used in such vaccine.

If the use is a vaccination, a recombinant adenovirus of the invention can be administered in an immunologically and/or prophylactically effective dose which is preferably $1 \times 10^8$ to $1 \times 10^{11}$ viral particles (i.e., $1 \times 10^8$, $5 \times 10^8$, $1 \times 10^9$, $5 \times 10^9$, $1 \times 10^{10}$, $2.5 \times 10^{10}$ or $5 \times 10^{10}$ particles).

Furthermore, for a vaccination which requires a boosting, it is preferred to apply a "heterologous prime-boost" methodology: In vaccination, the polynucleotide of the first or second aspect, at least one isolated adenoviral capsid polypeptide of the third aspect, the adenovirus of the fourth aspect, a virus-like particle of the fifth aspect, or a vector of the sixth aspect and/or the composition of the seventh aspect may be used for priming or for boosting, in particular for a heterologous prime-boost vaccination. In a preferred embodiment of heterologous prime-boost two different vaccines, e.g. adenoviruses may be used, wherein it is particularly advantageous that the polynucleotide of the first or second aspect, at least one isolated adenoviral capsid polypeptide of the third aspect, the adenovirus of the fourth aspect, a virus-like particle of the fifth aspect, or a vector of the sixth aspect and/or the composition of the seventh aspect is used as the boost vaccine due to the lack or neutralizing antibodies in e.g. humans.

A recombinant adenovirus prepared using a polynucleotide or recombinant adenoviral protein or fragment thereof according to the invention can be used to transduce a host cell with a polynucleotide, e.g. DNA. Tus, a preferably replication deficient, albeit infectious (i.e. capable of entering a host cell) adenovirus can be prepared to express any custom protein or polypeptide in a host cell. Thus, in a preferred embodiment, the therapy recited in the use according to the invention is gene therapy. The gene therapy may be an in vivo, ex vivo, or in vitro gene therapy. Preferably, it is a somatic gene therapy. If an isolated polynucleotide, an isolated protein, a vector, a recombinant adenovirus and/or a pharmaceutical composition according to the invention is used for gene therapy and is administered to a subject to be treated, it is preferred that it is administered in a sufficiently large dose such that the treatment results in one or more cells of the patient being transfected, i.e. transduced. If a recombinant adenovirus and/or a pharmaceutical composition according to the invention is administered by any of the preferred means of administrations disclosed herein, it is preferred that an effective dose which is preferably $1 \times 10^8$ to $5 \times 10^{11}$ viral particles (i.e., $1 \times 10^8$, $5 \times 10^8$, $1 \times 10^9$, $5 \times 10^9$, $1 \times 10^{10}$, $2.5 \times 10^{10}$, $5 \times 10^{10}$, $1 \times 10^{11}$ or, most preferably, $5 \times 10^{11}$ particles) is administered. In preferred embodiments, the preferably heterologous polynucleotide that is comprised in the recombinant adenovirus of the invention is capable of expressing a protein or polypeptide in a host cell of the subject, wherein the protein or polypeptide comprises a signal peptide which effects secretion of the protein or polypeptide from said host cell. For example, a patient in need of a certain protein can be treated using an adenovirus of the present invention which comprises a cDNA that encodes a secretable form of that protein.

In a further embodiment of the use of the present invention, a polynucleotide of the first or second aspect, at least one isolated adenoviral capsid polypeptide of the third aspect, the adenovirus of the fourth aspect, a virus-like particle of the fifth aspect, or a vector of the sixth aspect and/or the composition of the seventh aspect (in the following referred to as pharmaceutical according to the invention) is formulated to further comprise one or more pharmaceutically acceptable diluents; carriers; excipients, including fillers, binders, lubricants, glidants, disintegrants, and adsorbents; and/or preservatives.

The pharmaceutical according to the invention can be administered by various well known routes, including oral, rectal, intragastrical and parenteral administration, e.g. intravenous, intramuscular, intranasal, intradermal, subcutaneous and similar administration routes. Parenteral-, intramuscular- and intravenous administration is preferred. Preferably the pharmaceutical according to the invention is formulated as syrup, an infusion or injection solution, a tablet, a capsule, a capslet, lozenge, a liposome, a suppository, a plaster, a band-aid, a retard capsule, a powder, or a slow release formulation. Preferably the diluent is water, a buffer, a buffered salt solution or a salt solution and the carrier preferably is selected from the group consisting of cocoa butter and vitebesole.

Particular preferred pharmaceutical forms for the administration of the pharmaceutical according to the invention during the use of the present invention are forms suitable for injectable use and include sterile aqueous solutions or dispersions and sterile powders for the extemporaneous preparation of sterile injectable solutions or dispersion. Typically, such a solution or dispersion will include a solvent or dispersion medium, containing, for example, water-buffered aqueous solutions, e.g. biocompatible buffers, ethanol, polyol, such as glycerol, propylene glycol, polyethylene glycol, suitable mixtures thereof, surfactants or vegetable oils.

Infusion or injection solutions can be accomplished by any number of art-recognized techniques including but not limited to addition of preservatives like anti-bacterial or anti-fungal agents, e.g. parabene, chlorobutanol, phenol, sorbic acid or thimersal. Further, isotonic agents, such as sugars or salts, in particular sodium chloride may be incorporated in infusion or injection solutions.

Preferred diluents of the present invention are water, physiological acceptable buffers, physiological acceptable buffer salt solutions or salt solutions. Preferred carriers are cocoa butter and vitebesole. Excipients which can be used with the various pharmaceutical forms of the pharmaceutical according to the invention can be chosen from the following non-limiting list:
a) binders such as lactose, mannitol, crystalline sorbitol, dibasic phosphates, calcium phosphates, sugars, microcrystalline cellulose, carboxymethyl cellulose, hydroxyethyl cellulose, polyvinyl pyrrolidone and the like;
b) lubricants such as magnesium stearate, talc, calcium stearate, zinc stearate, stearic acid, hydrogenated vegetable oil, leucine, glycerides and sodium stearyl fumarates, c) disintegrants such as starches, croscarmellose, sodium methyl cellulose, agar, bentonite, alginic acid, carboxymethyl cellulose, polyvinyl pyrrolidone and the like.

Other suitable excipients can be found in the Handbook of Pharmaceutical Excipients, published by the American Pharmaceutical Association.

Certain amounts of the pharmaceutical according to the invention are preferred for the therapy or prophylaxis of a disease. It is, however, understood that depending on the severity of the disease, the type of the disease, as well as on the respective patient to be treated, e.g. the general health status of the patient, etc., different doses of the pharmaceutical according to the invention are required to elicit a therapeutic or prophylactic effect. The determination of the appropriate dose lies within the discretion of the attending physician. If the pharmaceutical according to the invention is to be used prophylactically, it may be formulated as a vaccine. In this case the pharmaceutical according to the invention is preferably administered in above outlined preferred and particular preferred doses. Preferably, the administration of the vaccine is repeated at least two, three, four, five, six, seven, eight nine or at least 10 times over the course of a defined period of time, until the vaccinated subject has generated sufficient antibodies against the pharmaceutical according to the invention so that the risk of developing the respective disease has lessened. The period of time in this case is usually variable depending on the antigenicity of the vaccine. Preferably the period of time is not more than four weeks, three months, six months or three years. In one embodiment, if an adenovirus according to the invention is used for vaccination purposes, at least one of the hypervariable domains of the hexon protein can be replaced by an immunogenic epitope of the respective disease agent that the vaccination is directed against. Vaccines typically contain one or more adjuvants as outlined above. A detailed summary of the use of adenoviruses for vaccination and methods pertaining thereto is provided in: Bangari D S and Mittal S K (2006) Vaccine, 24(7), p. 849-862; see also: Zhou D, et al., Expert Opin Biol Ther. 2006 January; 6(1):63-72; and: Folgori A, et al., Nat Med. 2006 February; 12(2):190-7; see also: Draper S J, et al., Nat Med. 2008 August; 14(8):819-21. Epub 2008 Jul. 27.

In a tenth aspect, the present invention relates to an in vitro method for producing an adenovirus or an adenovirus-like particle, comprising the steps of
(i) expressing an isolated polynucleotide of the first or second aspect in a cell such that an adenovirus or an adenovirus-like particle is assembled in the cell,
(ii) isolating the adenovirus or the adenovirus-like particle from the cell or the medium surrounding the cell.

The method optionally comprises a further step prior to step (i) of introducing the isolated polynucleotide of the first or second aspect or a vector of the sixth aspect into the cell, e.g. as described above.

It is generally preferred that the isolated polynucleotide encodes an adenovirus of the fourth aspect or a virus-like particle of the fifth aspect. The adenovirus is preferably replication-incompetent. The cell is preferably a cell of the seventh aspect. If the isolated polynucleotide encodes a replication-incompetent adenovirus, it is preferred that the cell is a helper cell or comprises a helper construct (e.g. a helper plasmid or helper virus, e.g. as it is transduced with a helper construct, preferably infected with a helper virus, prior to or during step (i)) as described herein, wherein the helper cell or the helper construct, respectively, expresses the genes/genomic regions that render the adenovirus replication-incompetent.

"Such that an adenovirus or an adenovirus-like particle is assembled in the cell" means that in step (i), all genes necessary for assembling the adenovirus or the adenovirus-like particle, as described herein, are expressed in the cell. This comprises all genes necessary for packaging the adenovirus (i.e. packaging the genome into the virus capsid) if an adenovirus is to be assembled.

In a preferred embodiment, the isolated polynucleotide encodes a VA RNA II non-coding RNA and/or a VA RNA I non-coding RNA as defined above. A VA RNA according to the invention leads to an improved adenovirus or adenovirus-like particle yield of the method as shown in Example 1.

Definitions and Further Embodiments of the Invention

In the following, some definitions of terms frequently used in this specification are provided. These terms will, in each instance of its use, in the remainder of the specification have the respectively defined meaning and preferred meanings.

As used herein, the term "isolated" refers to a molecule which is substantially free of other molecules with which it is naturally associated with. In particular, isolated means the molecule is not in an animal body or an animal body sample. An isolated molecule is thus free of other molecules that it would encounter or contact in an animal. Isolated does not mean isolated from other components associated with as described herein, e.g. not isolated from other components of a composition the molecule is comprised in, or isolated from a vector or cell it is comprised in.

The term "polynucleotide" is intended to refer to a nucleic acid, i.e. a biological molecule made up of a plurality of nucleotides. It includes DNA, RNA and synthetic analogs, e.g. PNA. DNA is preferred.

The term "open reading frame" (ORF) refers to a sequence of nucleotides that can be translated into amino acids. Typically, an ORF contains a start codon, a subsequent region usually having a length which is a multiple of 3 nucleotides, but does not contain a stop codon (TAG, TAA, TGA, UAG, UAA, or UGA) in the given reading frame. An ORF codes for a protein where the amino acids into which it can be translated form a peptide-linked chain.

As used herein, the term "protein", "peptide", "polypeptide", "peptides" and "polypeptides" are used interchangeably throughout. These terms refers to both naturally occurring peptides, e.g. naturally occurring proteins and synthesized peptides that may include naturally or non-naturally occurring amino acids. Peptides can be also chemically modified by modifying a side chain or a free amino or carboxy-terminus of a natural or non-naturally occurring amino acid. This chemical modification includes the addition of further chemical moieties as well as the modification of functional groups in side chains of the amino acids, such as a glycosylation. A peptide is a polymer preferably having at least 3, 4, 5, 6, 7, 8, 9, 10, 15, 20, 25, 30, 35, 40, 45, 50, 55, 60, 65, 70, 75, 80, 85, 90, 95, or at least 100 amino acids, most preferably at least 8 or at least 30 amino acids. As the polypeptides and proteins disclosed herein are derived from adenovirus, it is preferred that the molecular mass of an isolated polypeptide or protein as used herein does not exceed 200 kDa.

An adenovirus (Ad) is a non-enveloped, icosahedral virus that has been identified in several avian and mammalian hosts. Human adenoviruses (hAds) belong to the Mastadenovirus genus which includes all known human and many Ads of animal (e. g., bovine, porcine, canine, murine, equine, simian and ovine) origin. Human adenoviruses are generally divided into six subgroups (A-F) based on a number of biological, chemical, immunological and structural criteria which include hemagglutination properties of rat and rhesus monkey erythrocytes, DNA homology, restriction enzyme cleavage patterns, percentage G+C content and oncogenicity (Straus, 1984, in *The Adenoviruses*, ed. H. Ginsberg, pps. 451-498, New York: Plenus Press, and Horwitz, 1990; in *Virology*, eds. B. N. Fields and D. M. Knipe, pps. 1679-1721).

The adenoviral virion has an icosahedral symmetry and, depending on the serotype, a diameter of 60-90 nm. The icosahedral capsid comprises three major proteins, hexon (II), penton base (III) and a knobbed fiber (IV) protein (W. C. Russel, J. Gen. Virol., 81: 2573-2604 (2000)). More specifically, the adenoviral capsid comprises 252 capsomeres, of which 240 are hexons and 12 are pentons. The hexons and pentons are derived from three different viral polypeptides. The hexon comprises three identical polypeptides, namely polypeptide II. The penton comprises a penton base, which provides a point of attachment to the capsid, and a trimeric fiber protein, which is noncovalently bound to and projects from the penton base. Other proteins, namely proteins IX, VI, and IIIa are usually also present in the adenoviral capsid. These proteins are believed to stabilize the viral capsid.

One aspect of the preexisting immunity that is observed in humans is humoral immunity, which can result in the production and persistence of antibodies that are specific for adenoviral proteins. The humoral response elicited by adenovirus is mainly directed against the hypervariable regions of the structural protein hexon. Adenoviruses isolated from non human great apes are closely related to adenoviruses isolated from humans as demonstrated by their efficient propagation in cells of human origin.

The capsid can be modified as described herein by incorporating non-adenoviral polypeptides, such as T- and/or B-cell epitopes.

The term "hexon protein" refers to the hexon (II) protein comprised in an adenovirus. A hexon protein or a variant thereof according to the invention has the same function as a hexon protein or a fragment thereof in an infectious adenovirus virion. Thus, an adenovirus comprising said hexon or variant thereof preferably as a capsid protein is capable of entering a host cell. A suitable method for generating variants of a hexon protein is described in U.S. Pat. No. 5,922,315. In this method, at least one loop region of the adenovirus hexon is changed with at least one loop region of another adenovirus serotype. It can be easily determined if a recombinant adenovirus can enter a host cell. For example, after contacting a host cell with the adenovirus, the recombinant host cell can be washed and lysed and it can be determined whether adenoviral RNA and/or DNA is found in the host cell using, e.g. an appropriate hybridization probe specific for adenoviral RNA and/or DNA. Alternatively or additionally, the host cell after having been brought into contact with the recombinant adenovirus may be washed, lysed and probed with adenovirus specific antibodies, e.g. using a Western blot. In yet another alternative, it is observed, e.g. in vivo, whether the host cell expresses a gene product, for example a fluorescent protein upon infection with a recombinant adenovirus that comprises a suitable expression cassette to express the gene product in the host cell.

The term "hypervariable region" refers to domains with high sequence variation between strains, located at the solvent-exposed surface of the hexon protein, so exposed on the outside of the viral capsid. They are major determinants of neutralizing antibodies. HVRs can be identified, for example, by sequence alignment with other hexon proteins.

By "adenoviral penton protein" is meant the penton base (III) protein comprised in an adenovirus. An adenoviral penton protein is characterized in that it localizes to the corners of the icosahedral symmetry of the capsid. A penton protein or a variant thereof according to the invention has the same function as a penton protein in an infectious adenovirus virion. Thus, an adenovirus comprising said penton or variant thereof preferably as a capsid protein is capable of entering a host cell, which can be tested as described above. Further, a functional penton has an affinity to an adenoviral fiber protein. The average skilled person is well aware of how to test protein-protein affinities. To determine if a first protein is capable of binding a second protein, he may use, for example, a genetic yeast two-hybrid assay or a biochemical assay such as a pull-down, an enzyme-linked immunosorbent assay (ELISA), a fluorescence-activated cell sorting (FACS)-based assay or a Plasmon resonance assay. When using pull-down or Plasmon resonance assays, it is useful to fuse at least one of the proteins to an affinity tag such as HIS-tag, GST-tag or other, as is well known in the art of biochemistry.

The term "fiber protein" refers to the knobbed fiber (IV) protein comprised in an adenovirus. A fiber protein or a variant thereof according to the invention has the same function as a fiber protein or a fragment thereof in an infectious adenovirus virion. Thus, an adenovirus comprising said fiber or fiber variant preferably as a capsid protein is capable of entering a host cell, which can be tested as described above. Further, a functional fibre protein has an affinity to an adenoviral penton protein. Also, a functional adenoviral fiber protein in its glycosylated form is capable of trimerizing. Thus, it is also preferred that the variant is capable of being glycosylated and/or of forming a trimer. Affinity, including trimerization, can be tested as described above, and glycosylation assays are also well-known in the art. The "VA (viral associated) RNA" is a type of non-coding found in adenovirus. It plays a role in regulating translation. There are two copies of this RNA called VAI or VA RNA I and VAII or VA RNA II. The two VA RNA genes are distinct genes in the adenovirus genome. VA RNA I is the major species with VA RN All expressed at a lower level. Neither transcript is polyadenylated and both are transcribed by PolIII.

The term "identity" or "identical" in the context of polynucleotide, polypeptide or protein sequences refers to the number of residues in the two sequences that are identical when aligned for maximum correspondence. Specifically, the percent sequence identity of two sequences, whether nucleic acid or amino acid sequences, is the number of exact matches between two aligned sequences divided by the length of the shorter sequence and multiplied by 100. Alignment tools that can be used to align two sequences are well known to the person skilled in the art and can, for example, be obtained on the World Wide Web, e.g., Clustal Omega for polypeptide alignments or MUSCLE or MAFFT for polynucleotide alignments or WATER for polynucleotide and polypeptide alignments. The alignments between two sequences may be carried out using default parameters settings, e.g. for MAFFT preferably: Matrix: Blosum62, Gap Open 1.53, Gap Extend 0.123, for WATER polynucleotides preferably: MATRIX: DNAFULL, Gap Open: 10.0, Gap Extend 0.5 and for WATER polypeptides preferably MATRIX: BLOSUM62, Gap Open: 10.0, Gap Extend: 0.5. Those skilled in the art understand that it may be necessary to introduce gaps in either sequence to produce a satisfactory alignment. The "best sequence alignment" is defined as the alignment that produces the largest number of aligned identical residues while having a minimal number of gaps. Preferably, it is a global alignment, which includes every residue in every sequence in the alignment.

The term "variant" refers, with respect to a polypeptide, generally to a modified version of the polypeptide, e.g. a mutation, so one or more amino acids of the polypeptide may be deleted, inserted, modified and/or substituted. Generally, the variant is functional, meaning that an adenovirus comprising the functional variant is capable of infecting a host cell. More specific functions are defined herein and have precedence over the general definition. A "mutation" or "amino acid mutation" can be an amino acid substitution, deletion and/or insertion ("and" may apply if there is more than one mutation). Preferably, it is a substitution (i.e. a conservative or non-conservative amino acid substitution), more preferably a conservative amino acid substitution. In some embodiments, a substitution also includes the exchange of a naturally occurring amino acid with a not naturally occurring amino acid. A conservative substitution comprises the substitution of an amino acid with another amino acid having a chemical property similar to the amino acid that is substituted. Preferably, the conservative substitution is a substitution selected from the group consisting of:

(i) a substitution of a basic amino acid with another, different basic amino acid;
(ii) a substitution of an acidic amino acid with another, different acidic amino acid;
(iii) a substitution of an aromatic amino acid with another, different aromatic amino acid;
(iv) a substitution of a non-polar, aliphatic amino acid with another, different non-polar, aliphatic amino acid; and
(v) a substitution of a polar, uncharged amino acid with another, different polar, uncharged amino acid.

A basic amino acid is preferably selected from the group consisting of arginine, histidine, and lysine. An acidic amino acid is preferably aspartate or glutamate. An aromatic amino acid is preferably selected from the group consisting of phenylalanine, tyrosine and tryptophane. A non-polar, aliphatic amino acid is preferably selected from the group consisting of glycine, alanine, valine, leucine, methionine and isoleucine. A polar, uncharged amino acid is preferably selected from the group consisting of serine, threonine, cysteine, proline, asparagine and glutamine. In contrast to a conservative amino acid substitution, a non-conservative amino acid substitution is the exchange of one amino acid with any amino acid that does not fall under the above-outlined conservative substitutions (i) through (v).

Means for determining sequence identity are described above.

Amino acids of a protein may also be modified, e.g. chemically modified. For example, the side chain or a free amino or carboxy-terminus of an amino acid of the protein or polypeptide may be modified by e.g. glycosylation, amidation, phosphorylation, ubiquitination, etc. The chemical modification can also take place in vivo, e.g. in a host-cell, as is well known in the art. For example, a suitable chemical modification motif, e.g. glycosylation sequence motif present in the amino acid sequence of the protein will cause the protein to be glycosylated. Unless a modification leads to a change in identity of a modified amino acid (e.g. a substitution or deletion), a modified polypeptide is within the scope of polypeptide as mentioned with respect to a certain SEQ ID NO, i.e. it is not a variant as defined herein.

The term "variant" refers, with respect to a polynucleotide, generally to a modified version of the polynucleotide, e.g. a mutation, so one or more nucleotides of the polynucleotide may be deleted, inserted, modified and/or substituted. Generally, the variant is functional, meaning that an adenovirus comprising the functional variant is capable of infecting a host cell. More specific functions are defined herein and have precedence over the general definition. A "mutation" can be an nucleotide substitution, deletion and/or insertion ("and" may apply if there is more than one mutation). Preferably, it is a substitution, more preferably it causes an amino acid substitution, most preferably a conservative amino acid substitution.

An "antigenic protein or fragment thereof" (wherein the fragment is also antigenic) is capable of eliciting an immune response in a mammal. Preferably, it is a tumor antigen or an antigen derived from a pathogen. The term "pathogen" refers to any organism which may cause disease in a subject. It includes but is not limited to bacteria, protozoa, fungi, nematodes, viroids, viruses and parasites, wherein each pathogen is capable, either by itself or in concert with another pathogen, of eliciting disease in vertebrates including but not limited to mammals, and including but not limited to humans. As used herein, the term "pathogen" also encompasses organisms which may not ordinarily be pathogenic in a non-immunocompromised host, but are in an immunocompromised host.

Generally speaking, the adenoviral genome is well characterized. There is general conservation in the overall organization of the adenoviral genome with respect to specific open reading frames being similarly positioned, e.g. the location of the E1A, E1B, E2A, E2B, E3, E4, LI, L2, L3, L4 and L5 genes of each virus. Each extremity of the adenoviral genome comprises a sequence known as an inverted terminal repeat (ITRs), which is necessary for viral replication. The virus also comprises a virus-encoded protease, which is necessary for processing some of the structural proteins required to produce infectious virions. The structure of the adenoviral genome is described on the basis of the order in which the viral genes are expressed following host cell transduction. More specifically, the viral genes are referred to as early (E) or late (L) genes according to whether transcription occurs prior to or after onset of DNA replication. In the early phase of transduction, the E1A, E1B, E2A, E2B, E3 and E4 genes of adenovirus are expressed to prepare the host cell for viral replication. During the late phase of infection, expression of the late genes L1-L5, which encode the structural components of the virus particles are activated.

The term "vector" as used herein includes any vectors known to the skilled person including plasmid vectors, cosmid vectors, phage vectors such as lambda phage, viral vectors such as adenovirus (Ad) vectors (e.g., non-replicating Ad5, Ad11, Ad26, Ad35, Ad49, ChAd3, ChAd4, ChAd5, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd63 and ChAd82 vectors or replication-competent Ad4 and Ad7 vectors known from the prior art, e.g. WO 2005/071093 A2), adeno-associated virus (AAV) vectors (e.g., AAV type 5), alphavirus vectors (e.g., Venezuelan equine encephalitis virus (VEE), sindbis virus (SIN), semliki forest virus (SFV), and VEE-SIN chimeras), herpes virus vectors, measles virus vectors, pox virus vectors (e.g., vaccinia virus, modified vaccinia virus Ankara (MVA), NYVAC (derived from the Copenhagen strain of vaccinia), and avipox vectors: canarypox (ALVAC) and fowlpox (FPV) vectors), and vesicular stomatitis virus vectors, viral like particles, or bacterial spores. A vector also includes expression vectors, cloning vectors and vectors that are useful to generate recombinant adenoviruses in host cells.

As stated above, a "heterologous protein or fragment thereof" can be a non-adenoviral protein or fragment thereof, in particular an antigenic protein or fragment thereof. To this end, the polynucleotide encoding a heterologous protein may be a molecule to be delivery into a target cell, e.g. a polynucleotide encoding an antigenic protein or a fragment thereof, preferably an antigenic protein or a fragment of a pathogen such as a pathogenic virus, bacterium, fungus, protozoan or parasite, or a tumor antigen. "Antigen" refers to any protein or peptide capable of eliciting an immune response in a mammal. An antigen comprises preferably at least 8 amino acids and most preferably comprises between 8 and 12 amino acids.

The term "expression cassette" refers to a nucleic acid molecule which comprises at least one nucleic acid sequence that is to be expressed, along with its transcription and translation control sequences. Changing the expression cassette will cause the vector in which it is incorporated to direct the expression of a different sequence or combination of sequences. Because of the restriction sites being preferably engineered to be present at the 5' and 3' ends, the cassette can be easily inserted, removed, or replaced with another cassette. Preferably, an expression cassette includes cis-regulating elements for efficient expression of a given gene, such as promoter, initiation-site and/or polyadenylation-site. More specific with respect to the present invention, an expression cassette contains all the additional elements required for the expression of the polynucleotide of the first or second aspect in host cells. A typical expression cassette thus contains a promoter operatively linked to the polynucleotide of the first or second aspect and signals required for efficient polyadenylation of the transcript, ribosome binding sites, and translation termination. Additional elements of the cassette may include, for example enhancers. An expression cassette should also contain a transcription termination region downstream of the structural gene to provide for efficient termination. The termination region may be obtained from the same gene as the promoter sequence or may be obtained from different genes.

As used herein, the term "minigene" refers to a heterologous gene construct wherein one or more functionally nonessential segments of a gene are deleted with respect to the naturally occurring gene. A "minigene cassette" is an expression cassette comprising a minigene for expression.

The term "replication-competent" recombinant adenovirus (AdV) refers to an adenovirus which can replicate in a host cell in the absence of any recombinant helper proteins comprised in the cell. Preferably, a "replication-competent" adenovirus comprises the following intact or functional essential early genes: E1A, E1B, E2A, E2B, E3 and E4. Wild type adenoviruses isolated from a particular animal will be replication competent in that animal.

The term "replication-defective" or "replication-incompetent" recombinant AdV refers to an adenovirus that has been rendered to be incapable of replication because it has been engineered to comprise at least a functional deletion, i.e. a deletion which impairs the function of a gene without removing it entirely, e.g. introduction of artificial stop codons, deletion or mutation of active sites or interaction domains, mutation or deletion of a regulatory sequence of a gene etc, or a complete removal of a gene encoding a gene product that is essential for viral replication, such as one or more of the adenoviral genes selected from E1, E2, E3 and E4. The recombinant adenoviral viruses of the invention are preferably replication-defective.

The term "recombinant adenovirus" refers in particular to an adenovirus that is modified to comprise a heterologous polynucleotide and/or polypeptide sequence. "Heterologous" can mean from another adenovirus strain, in particular a strain from a different host (e.g. a human host, so from a human adenovirus such as Ad3 or Ad5), or from a non-adenoviral organism such an antigen derived from a pathogen as described herein, or from human such as a human tumor antigen. As such, the term comprises chimeric and carrier adenoviruses, respectively. A recombinant adenovirus can comprise a heterologous polynucleotide and/or polypeptide sequence from both other adenoviruses or from non-adenoviral organisms, i.e. it can be both a chimeric and a carrier adenovirus.

As used herein, the term "virus-like particle" or "VLP" refers to a non-replicating, empty viral shell, derived in this case from an adenovirus. VLPs are generally composed of one or more viral proteins, such as, but not limited to those proteins referred to as capsid, coat, shell, surface and/or envelope proteins. They contain functional viral proteins responsible for cell penetration by the virus, which ensures efficient cell entry. VLPs can form spontaneously upon recombinant expression of the protein in an appropriate expression system. Methods for producing particular VLPs are known in the art. Adenovirus VLPs in particular can be produced by functionally impairing, e.g. deleting or introducing a null-mutation into the Iva2 gene of an adenovirus, which is involved in viral DNA packing (Ostapchuk et al. J Virol. 2011 June; 85(11): 5524-5531). The presence of VLPs can be detected using conventional techniques known in the art, such as by electron microscopy, X-ray crystallography, and the like. See, e.g., Baker et al., Biophys. J. (1991) 60:1445-1456; Hagensee et al., J. Virol. (1994) 68:4503-4505. For example, cryoelectron microscopy can be performed on vitrified aqueous samples of the VLP preparation in question, and images recorded under appropriate exposure conditions.

"Substantially no viral genomic DNA" comprised in a VLP means that there is either no viral genomic DNA in the VLP or not sufficient viral DNA in the VLP to allow virus replication in a cell infected with the VLP and not expressing DNA that would complement the DNA in the VLP such that virus replication can occur.

Further to the above, an "epitope", also known as antigenic determinant, is the segment of a macromolecule that is recognized by the immune system, specifically by antibodies, B cells, or T cells. In the context of the present invention it is preferred that the term "epitope" refers to the segment of protein or polyprotein that is recognized by the immune system. Epitopes usually consist of chemically active surface groupings of molecules such as amino acids or sugar side chains and usually have specific three-dimensional structural characteristics, as well as specific charge characteristics. Conformational and non-conformational epitopes are distinguished in that the binding to the former but not the latter is lost in the presence of denaturing solvents.

A "non-adenoviral T-cell epitope" is an epitope that can be presented on the surface of an antigen-presenting cell, where it is bound to an MHC molecule. In humans, professional antigen-presenting cells are specialized to present MHC class II peptides, whereas most nucleated somatic cells present MHC class I peptides. T-cell epitopes presented by MHC class I molecules are typically peptides between 8 and 11 amino acids in length, whereas MHC class II molecules present longer peptides, 13-17 amino acids in length.

A "non-adenoviral B-cell epitope" is an epitope that is recognised as three-dimensional structures on the surface of native antigens by B-cells.

B- and T-cell epitopes can be predicted with in silico tools, e.g. the online B- or T-cell prediction tools of the IEDB Analysis Resource.

The term "presents one or more non-adenoviral B-cell epitopes" means that the one or more epitopes are incorporated into the capsid such that they be recognized by B-cells. The term "incorporates one or more non-adenoviral B-/T-cell epitopes" means that the epitope is either contained in the VLP without being incorporated in the capsid, or is incorporated in the capsid. If it is incorporated in the capsid, it may or may not be presented to the outside such that it can be recognized by immune cells.

An "immunological adjuvant" or simply "adjuvant" is a substance that accelerates, prolongs and/or enhances the quality and/or strength of an immune response to an antigen/immunogen, in comparison to the administration of the antigen alone, thus, reducing the quantity of antigen/immunogen necessary in any given vaccine, and/or the frequency of injection necessary in order to generate an adequate immune response to the antigen/immunogen of interest. Examples of adjuvants that may be used in the context of the composition according to the present invention are gel-like precipitates of aluminum hydroxide (alum); $AlPO_4$; alhydrogel; bacterial products from the outer membrane of Gram-negative bacteria, in particular monophosphoryl lipid A (MPLA), lipopolysaccharides (LPS), muramyl dipeptides and derivatives thereof; Freund's incomplete adjuvant; liposomes, in particular neutral liposomes, liposomes containing the composition and optionally cytokines; non-ionic block copolymers; ISCOMATRIX adjuvant (Drane et al., 2007); unmethylated DNA comprising CpG dinucleotides (CpG motif), in particular CpG ODN with a phosphorothioate (PTO) backbone (CpG PTO ODN) or phosphodiester (PO) backbone (CpG PO ODN); synthetic lipopeptide derivatives, in particular $Pam_3Cys$; lipoarabinomannan; peptidoglycan; zymosan; heat shock proteins (HSP), in particular HSP 70; dsRNA and synthetic derivatives thereof, in particular Poly I:poly C; polycationic peptides, in particular poly-L-arginine; taxol; fibronectin; flagellin; imidazoquinoline; cytokines with adjuvant activity, in particular GM-CSF, interleukin-(IL-)2, IL-6, IL-7, IL-18, type I and II interferons, in particular interferon-gamma, TNF-alpha; 25-dihydroxyvitamin D3 (calcitriol); and synthetic oligopeptides, in particular MHCII-presented peptides. Non-ionic block polymers containing polyoxyethylene (POE) and polyoxypropylene (POP), such as POE-POP-POE block copolymers may be used as an adjuvant (Newman et al., 1998). This type of adjuvant is particularly useful for compositions comprising nucleic acids as active ingredient.

The term "vaccination" in the context of the present invention is an active immunization, that is an induction of a specific immune response by administering (for example, subcutaneously, intradermally, intramuscularly, orally, nasally) of an antigen (a substance that the immune system is of the vaccinated individual as foreign and therefore recognized immunogenic) in a suitable immunogenic formulation. The antigen is thus used as a trigger for the immune system to build up a specific immune response to the antigen. A vaccination within the scope of the present invention can in principle be carried out both in the therapeutic sense, but also in the prophylactic sense. It includes vaccination against pathogens as described herein to treat or prevent infectious diseases, or vaccination to treat or prevent non-infectious diseases, such as cancer. In case of non-infectious diseases, the antigen is preferably a cellular membrane antigen, in particular one that is expressed only by a diseased cell, but not by non-diseased cells. An example is a tumor-associated antigen. In this context, the term "tumor-associated antigen" means a structure which is predominantly presented by tumor cells and thereby allows a differentiation from non-malignant tissue. Preferably, such a tumor-associated antigen is located on or in the cell membrane of a tumor cell. Examples of tumor-associated antigens are described, e.g., in DeVita et al. (Eds., "Biological Therapy of Cancer", 2. Edition, Chapter 3: Biology of Tumor Antigens, Lippincott Company, ISBN 0-397-51416-6 (1995)).

"Priming" as used herein refers to the administration of a vaccine for inducing/generating an immune response in a mammal, and "boosting" to the administration of a vaccine for enhancing an immune response in a mammal. The phrase "heterologous prime-boost" means that the vaccine for inducing/generating an immune response (priming) in a mammal and the vaccine for enhancing the immune response (boosting) in a mammal are different. Heterologous prime-boost is useful if a subject, e.g. patient has developed antibodies against a first vector and a boosting is required. In this context, a first (prime) and a second (boost) vaccine, e.g. adenovirus, are sufficiently different, if the antibody response induced during priming by the first vaccine does not prevent more than 70% or preferably more than 80% of the second vaccine particles administered for boosting from entering the nucleus of cells of the animal that has been subjected to priming and boosting.

The term "gene therapy" can be broadly defined as the concept of directed introduction of foreign genetic material into a cell, tissue or organ for correction of defective genes with the goal to improve the clinical status of a patient. As used herein, the term "gene therapy" preferably refers to "somatic therapy" and not to "germ line therapy", which would induce heritable changes passed from generation to generation, wherein the somatic therapy restricts the therapeutic effect to the treated individual. The gene therapy, preferably the somatic therapy, can be further discriminated by a fast and easy to perform direct gene transfer to the organism ("in vivo") or a sophisticated but more specific and controllable gene transfer to explanted cells or tissues ("ex vivo" or "in vitro"), which are re-implanted after treatment.

The term "neutralizing antibody" refers to an antibody that binds to an epitope of the adenovirus and prevents it from producing a productive infection in a host cell or prevents the transduction of a target cell with a replication incompetent vector expressing a transgene, e.g. the adenovirus DNA is capable of entering a cell, in particular a host cell.

Various modifications and variations of the invention will be apparent to those skilled in the art without departing from the scope of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in the relevant fields are intended to be covered by the present invention.

The invention is described by way of the following examples which are to be construed as merely illustrative and not limitative of the scope of the invention.

EXAMPLES

Example 1: Isolation of New Adenoviral Vectors

The construction of pGADNOU19 and pGADNOU20 vectors proceeded through the steps provided below. The pGADNOU19 and pGADNOU20 vectors were derived from the wild type Adenovirus strains isolated from stool samples obtained from healthy non human great apes using standard procedures. The wild type viruses were isolated by inoculating monolayers of HEK 293 and A549 cell with stool extracts. Cell monolayers were observed daily for the appearance of a cytopathic effect. Samples scored positive by observation under the microscope were harvested and then the cells were lysed by freeze-thaw (−700° C./37° C.). The clarified cell lysate was then used for the virus propagation by infecting monolayers of fresh cells. After two passages of virus amplification, the adenovirus was purified by using standard procedures. The viral genome was extracted from purified viruses by SDS/proteinase K digestion followed by phenol-chloroform extraction. The purified adenovirus DNA was cloned into a shuttle plasmid vector to be modified by carrying the following deletions of viral genome:

1) deletion of the E1 region (from bp 461 to bp 3402) of the viral genome
2) deletion of the E3 region (from bp 28472 to bp 31996) of the viral genome Example 2: Generation of GADNOU Shuttle Vectors The purified DNA genomes of the GADNOU viruses were first sequenced and then the DNA sequence information used to construct a shuttle vector for cloning the entire genome of GAd by homologous recombination. The shuttle vector was designed to introduce the E1 region deletion (nucleotides coordinates: 461-3402). Briefly, the shuttle vector used to clone the GADNOU viruses (referred to herein as pGAd-GAG shuttle) was constructed as follows:
a, GAd-GAG left end was amplified by PCR with oligonucleotides FW 5'-GAACTCCgaattcgtttaaaccatcat-caataatataccttattttggattgaggccaatatgataat-gaggtgggcggggcgaggc ggggcgggtgacgtagg-3' (SEQ ID NO: 58) and RV 5'-cataatcGGCCGCAGCGGCCCGTCAG ATGACGGCGACAATAAA-3' (SEQ ID NO: 59) digested with EcoRI and SfiI then ligated in pUC19 rc_MCS_Left end_PIX_Rightend_V1 digested with EcoRI and SfiI, thus generating pUC19 L-ITR GAd-GAG.
b. GAd right end was then amplified by PCR with oligonucleotides FW 5'-Cataatcgacccgagtcgcactctcacagcaccagca-3' (SEQ ID NO: 60) and RV 5'-GAACTCCggatccgtttaaac-CATCATCAATAATATACCTTATITTG-3' (SEQ ID NO: 61) digested with PshA1 and BamHI then ligated in pUC19 L-ITR GAd-GAG digested with PshA1 and BamHI, thus generating pUC19 L/R-ITR GAd-GAG.
c. The DNA fragment containing the pIX coding region was amplified by PCR with the oligonucleotides FW 5'-Cataatcgcgatcgcgcttaggcctgaccatctgg-3' (SEQ ID NO: 62) and RV 5'-GAACTCCggcgcgccTTAGGGG-GAGGCAAGGCTG-3' (SEQ ID NO: 63) digested with AsisI-AscI then cloned into plasmid pUC19 L/R-ITR GAd-GAG. digested with AsisI-AscI, generating pUC19 L/R-ITR pIX GAd-GAG.
d. The HCMV-GAG-BGHpolyA cassette was obtained from a plasmid phCMV-GAG digested with MscI-SfiI. The cassette was cloned into pUC19 L/R-ITR pIX GAd-GAG digested with MscI-SfiI and then blunted generating pGAd-GAG shuttle.
e. Construction of shuttle BAC by replacing the plasmid region with the BAC region: The BAC region was obtained from a plasmid pBELO BAC RDL digested with PmeI then cloned into plasmid pGAd-GAG shuttle digested with PmeI and thus generating BAC GAd-GAG shuttle
f. Insertion of Amp-LacZ-SacB selection cassette between right end and pIX region: Amp-LacZ-SacB selection cassette was obtained from plasmid pChAd shuttle plasmid by PCR using the oligonucleotides FW (5'-GAACTCCGGCGCGCCTAGG GATAACAGGGTAAT ACCCCTATITGTITATITITCT-3', SEQ ID NO: 64) and RV (5'-CATAATCGGCGCGCCATTACCCTGTTATCCCTAT-TATITGTTAACTGTTAA TTGTC-3', SEQ ID NO: 65) digested with AscI. The selection cassette was cloned into BAC GAd-GAG shuttle digested with AscI generating BAC GAd-GAG A/US shuttle (FIG. 1).

The shuttle plasmid has been designed to contain restriction enzyme sites (PmeI) that are present only at the end of both ITRs to allow the release of viral DNA from plasmid DNA.

Example 3: Construction of ΔE1 Vectors

GADNOU wt genomic DNA was isolated by Proteinase K digestion followed by phenol/chloroform extraction.

pGADNOU19 and pGADNOU20 vectors were obtained by homologous recombination in E. coli strain BJ5183. Cloning of viral DNA was obtained by co-transforming E. coli strain BJ5183 cells with purified WT viral DNA and the BAC GAd-GAG A/L/S shuttle. Homologous recombination between pIX genes, right ITR DNA sequences present at the ends of shuttle BAC (digested with AscI) and viral genomic DNA allowed its insertion in the BAC vector, by deleting at the same time the E1 region that was substituted by the expression cassette, generating ΔE1/GAG (BAC) vectors GADNOU19 GAG BAC and GADNOU20 GAG BAC. Screening was performed by restriction analysis and PCR sequencing on hexon region.

Example 4: Construction of ΔE3 Vectors

The construction strategy was based on two consecutive steps as described below:
a) Substitution of the E3 region with Amp-LacZ-SacB selection cassette: Amp-LacZ-SacB selection cassette was obtained from BAC GAd-GAG A/L/S shuttle by PCR using the oligonucleotides FW (5'-GGATACACCAA-GATCTTTGCTGTC ATTTGTGTGCT-GAGTATAATAAAGGCTGAGATCAGAATC-TACTCGACCCCTAT GTTTATTTTCT-3', SEQ ID NO: 66) and RV (5'-CTTGCTATCAGA TCAAGTAAGTGA-TATGATACAGTTATGATCAATGAAAGGGATAAG GTCTTATITGTTAACTGTTAATTGTC-3', SEQ ID NO: 67). The DNA fragment obtained by PCR was then cloned in GAdNou19 GAG BAC and GAdNou20 GAG BAC by recombineering technique obtaining GAdNou19 GAG (DE1E3) A/L/S BAC and GAdNou20 GAG (DE1 E3) A/L/S BAC
b) Deletion of the Amp-lacZ-SacB selection cassette for E3 region deletion: Amp-LacZ-SacB selection cassette was deleted using the single strand oligonucleotide (5' ctgtcat-ttgtgtgctgagctaaggetgagatcagaatctactcggaccttatccctttcaatt-gatcataactgtaatenntaaa tcactt-3', SEQ ID NO: 68) obtaining substitution of Amp-LacZ-SacB selection cassette with ss oligo and the subsequent deletion of E3 region. The ss oligo was used to replace the selection cassette into GADNOU19 GAG (DE1E3) A/L/S BAC and GADNOU20 GAG (DE1E3) A/L/S BAC by recombineering techniques, to create the final plasmid GADNOU19 GAG (DE1E3) BAC (FIG. 2) and GADNOU20 GAG (DE1E3) BAC (FIG. 3).

Example 5: Improved Productivity of the New Adenoviral Vectors

The productivity of two non human great apes adenoviral vectors, GADNOU19 and GADNOU 20, carrying the E1 deletion and expressing the GAG antigen was evaluated in Hek293 adherent cells. The productivity was evaluated by infecting the T25 adherent cells with purified viruses at MOI 100 and MOI 300 vp/cells, in comparison with the benchmark Ad5 vector carrying the same expression cassette. The infected cells were harvested three 25 days post infection, when the full cytopathic effect was evident; the virus was released from the infected cells by three cycles of freeze/thaw (−70°/37° C.) and the lysates were then clarified by centrifugation. The clarified lysates were quantified by Quantitative PCR with primers and probe complementary to the CMV promoter region. The oligonucleotide sequences are the following: CMVfw for 5'-CATCTACGTATTAGT-CATCGCTATTACCA-3' (SEQ ID NO: 69), CMVrv 5'-GACTTGGAAATCCCCGTGAGT-3' (SEQ ID NO: 70), CMVFAM-TAMRA probe 5'-ACATCAATGGGCGTGGA-TAGCGGTT-3' (SEQ ID NO: 71). QPCRs were run on an ABI Prism 7900 Sequence detector—Applied Biosystem. The resulting specific productivity expressed in virus particles per cell (vp/cell) of the GADNOU19 and GADNOU expressing GAG resulted to be significantly higher than the benchmark Ad5 vector carrying the same expression cassette (FIG. 1).

Rationale for improved productivity: The adenoviral genomes of the invention belong to the group C of adenoviruses, which are known to have a high immunological potency. At the same time, group C viruses are characterized by a relatively poor productivity. The inventors have discovered that the adenoviral genomes of the invention contain a particular genomic feature that is different from many other group C adenoviruses. The feature is represented by a pair of non-coding RNAs present in the genome (the so-called virus-associated (VA) RNAs I and II), each about 170 nucleotides in length and separated by about 60 nucleotides. Generally, both VA RNAs I and II are present but there are cases (group A viruses and some group B viruses) where only VA RNA I is present. These RNAs are known to be related to the interference of the virus with the cellular defense mechanism. In addition, both VA RNA I and II are further processed by cellular enzymes into microRNAs. The precise function of these microRNAs is however not known.

By analyzing the sequences of known adenoviruses, the inventors have discovered that the VA RNA I and II of the genomes of the invention do not resemble the VA RNA I and II sequences of other group C adenoviruses (for example the human Ad5 and Ad2, but also many chimpanzee isolates belonging to group C), but instead more closely resemble VA RNA I and VA RNA II from groups B and E. The average sequence identities of VA RNA I and II sequences within and between groups has been calculated and is shown in Table 3 below.

TABLE 3

Average percent sequence identity of VA RNA I within groups C*, B, E, D, A, C and VA RNA II within groups C*, B, E, D, C and the average sequence percent identity between group C* with respect to the other groups. Group C* represents GADNOU viruses according to the invention.

| | VA RNA I | | | VA RNA II | |
|---|---|---|---|---|---|
| Group | Group average % sequence identity | Average % sequence identity against group C* | Group | Group average % sequence identity | Average % sequence identity against group C* |
| C* | 99.5 | | C* | 100.0 | |
| B | 87.7 | 71.0 | B | 95.9 | 81.3 |
| E | 97.3 | 68.8 | E | 93.1 | 77.8 |
| D | 97.5 | 67.2 | D | 98.2 | 65.3 |

TABLE 3-continued

Average percent sequence identity of VA RNA I within groups C*, B, E,
D, A, C and VA RNA II within groups C*, B, E, D, C and the average sequence
percent identity between group C* with respect to the other groups.
Group C* represents GADNOU viruses according to the invention.

| | VA RNA I | | | VA RNA II | |
|---|---|---|---|---|---|
| Group | Group average % sequence identity | Average % sequence identity against group C* | Group | Group average % sequence identity | Average % sequence identity against group C* |
| A | 94.4 | 51.0 | | | |
| C | 95.5 | 51.9 | C | 87.2 | 66.6 |

Therefore, it is believed that these RNAs lead to the higher replication of the viruses. According to the best knowledge of the inventors, the VA RNAs have as of yet never been correlated with improved productivity of adenoviruses.

Example 6: Gad Vector Immunogenicity

The immunogenicity of two GADNOU vectors (GADNOU19 GAG (DE1E3), SEQ ID NO: 72 and GADNOU20 GAG (DE1E3), SEQ ID NO: 73) encoding for HIV-1 gag (SEQ ID NO: 74) was evaluated in BALB/c mice. Six animals per group were immunized intramuscularly with escalating doses of each GADNOU vector. ELISpot was performed on splenocytes collected 3 weeks later by using as antigen a 9-mer peptide encoding the HIV gag major H-2 Kd CD8+ epitope (AMQMLKETI). Data show strong immunogenicity induced by both vectors at the highest tested dose of $3\times10^7$ vp (viral particles). Also at the lower dose of $3\times10^6$ vp, the two vectors were still capable of inducing a HIV-1 gag-specific T cell response in 50% of vaccinated mice (FIG. 5).

SEQUENCE LISTING (74 sequences)

SEQ ID NO: 1 - DNA, 37184 bp, Great Ape Adenovirus
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgatgaacttgaagatgaagaagcgcaagcacaagaggaagcccctgtgaaaaaaattcatgtatatgctcaggcgcctctttctggcgaaaagatttccaaggatggtatccaaataggtactgaagtcgtaggagatacatctaaggacacttttgcagataaaacattccaacccgaacctcagataggcgagtctcagtggaacgaggctgatgccacagcagcaggaggtagagttttgaaaaagactacccctatgagaccttgctatggatcctatgccaggcctaccaatgccaacgggggtcaaggaattatggttgccaatgaacaaggagtgttggagtctaaagtagaaatgcaatttttctctaacaccacaacccttaatgcgcgggatggaaccggcaatcccgaaccaaaggtggtgttgtacagcgaagatgtccacttggaatctcccgatactcatctgtcttacaagcccaaaaaggatgatgttaatgccaaaatcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttctgcttgattcaattggggatagaaccagatacttctccatgtggaaccaggcagtggatagctatgatccagatgtcagaattattgaaaaccatgggactgaggatgaactgcccaactactgcttccctttgggcggcataggagttactgatacttatcaagggataaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 2 - DNA, 37184 bp, Great Ape Adenovirus
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggtcccacttttaagccctactcgggcactgcctacaaccccctggctcctaagggcgcccccaattcttgtgagtgggaacaagaggaaaaccaggtggtcgctgcagatgatgaacttgaggatgaggaagcgcaggcacaagaggaagcccctgtgaaaaaaattcatgtgtatgctcaggcgcctctttccggcgaaaagatttccaaggatggcatccaaataggcactgaagtcgtaggagatacatctaaggacacttttgccgacaaaacattccagcccgaacctcagataggcgaatctcagtggaatgaagctgatgccacagcagcaggaggtagggttttgaagaagactactcccatgaggccttgttatggatcttatgctaggcctaccaatgccaacggaggccaaggaattatggttgccaatgaacaaggagtgttggagtctaaagtagaaatgcagtttttctctaacaccacaacccttaatgcgcgggatggaaccggcaatcccgaaccaaaggtggtgttgtatagtgaagatgtccacttggaatctcccgatactcacctgtcttacaagcccaaaaaggatgatgttaatgccaaaatcatgttgggccaacaggctatgcccaataggcccaatcttattggatttagagataatttcattgggctcatgttttacaacagcaccggtaacatgggagtgctggcgggtcaagcctctcagttgaatgctgtggtggacttgcaggatagaaacacagaactgtcgtatcagcttttgcttgattccattggggatagaaccagatatttctccatgtggaaccaggcagtggatagttatgacccagatgtcagaatcattgaaaaccacgggactgaggacgaactgcctaactactgttttcctctgggcggcattggagttacagatacttatcaagggataaaaaatactaatggcaatggtcaatggaccaaagatgatcagtttgcggaccgcaatgaaataggggtgggaaacaactttgccatggagatcaacatccaggccaacctctggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 3 - DNA, 37169 bp, Great Ape Adenovirus
catcatcaataatataccttattttggattgtggccaatatgataatgaggtgggcggggcgggtgacgtaggacgcgcgagtagggttgggaggtgtgcggaagtgtggcatttgcaagtgggaggagctcacatgtaagcttccgtcgcggaaaatgtgacgtttttaatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatctgacgcggagggtatttaaacccgctgcgctcctaaagaggccactcttgagtgccagcgagaagagttttctcctccgctccgtttcggcgatcgaaaaatgagacacttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggccgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcagggcaaggaaattaccttccattttgtgcaagcctaagacacctgtgaggaccagcgaggcggacagcactgactctggcacttctacctctcctcctgaaattcacccagtggttcctttgggtatacataaacctgttgctattagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtctccagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagtcggaggagcgagcggagaagatcagcttgagagccggcctggaccctcctcaggaggaatgaatctcccgcaggtggttgacctgtttcccgaactgagacgggtcctgactatcagggaagatggtcagtttgtgaagaagctgaagagggatcggggtgagggagatgatgaggcggctagcaatttagcttttagtctgataacccgccaccgaccggaatgtattacctatcagcagattaaggagagttgtgccaacgagctggatcttttgggtcagaagtatagcatagaacagcttaccacttactggcttcagcccggggatgattgggaagaggcgatcagggtgtatgcaaaggtggccctgcggcccgattgcaagtataagattactaagttggttaatattagaaactgctgctatatttctgggaacggggccgaagtggagatagatactgaggacagggtggctattaggtgttgcatgataaacatgtggcccgggatactggggatggatggggtgatatttatgaatgtaaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaacttcagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagcccctatctgacagtgcgcatgcctcactgggccggagtgcgtcagaatgtgatgggttccaacgtggatggacgtcccgttctgccttcaaattcgtctacgatggcctacgcgaccgtgggaggaactccgttggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagctgggaggggtgcatccggggggatatgatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttttccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagagtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggctgcccccatgctttttgatgcgtttcttacctcggctctccatgaggcggtgtcccttctcggtgacgaagaggctgtccgtgtccccgtagaccgatttcaggggcctgtcttccagcggagtgcctctgtcctcctcgtagagaaactctgaccactctgagacaaaggcccgtgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggtgccctttcatcttcactctcttccgcatcgctgtctgcgagagccagctgctggggtaagtattccctttcgaaggcgggcatgacctcagcgctcaggttgtcagtttctaaaaatgaggaagatttgatgttcacctgtccggaggtgatacctttgagggtacctgggtctatctggtcagaaaacactatttttttgttatcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagccgcggttgtgcagggtgaccatgtcgacgctggtggcgacctcaccgcgcaggcgctcgttggtccagcagaggcggccgcccttgcgcgagcagaaggggggtagggggtccagctggtcctcgttcggggggtccgcgtcgatggtaaagaccccggggagcagacgcgggtcaaagtagtcgatcttgcaagcttgcatgtccagagcccgctgccattcgcgggcggcgagcgcgcgctcgtaggggttgaggggcgggccccagggcatggggtgggtgagcgcagaggcgtacatgccgcagatgtcatacacgtacaggggttccctgaggatgccgaggtaggtggggtagcagcgccccccgcggatgctggcgcgcacgtagtcatagagttcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcacggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaggaagcggggctggcccttgatggaggggagctttttaagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcaatagaaggtgagggggtctttctcccaggggtcccatctgagctctcgggcgaggtcgcgtgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggtttacctcgcagagacgggtcaacgcacgggcagtgttaagatggtatctgatttcaaggggcgtgttggcggcggagtcgatggcttgcaggaggccgcagccccggggggccacgatggttccccgtggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacaaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctttcatctcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcctctccccgccccggtcaccacggccgcggcggccgtgtccggcgcggggggtgcgctggagtcagatgagccaccgcggcggcgacctaggcagtatctggacttggaagagggcgagggactggcgcggctgggggcgagctccccagagcgtcacccgcgggtgcagttgaaaagggacgcgcgcgaggcgtacctgccgcggcaaaacctgtttcgcgaccgcgggggcgaggagcccgaggagatgcgagactgcaggttccaagcagggcgcgagctgcgccgcggcttggacagagagcgcttgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgatgccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgcccgcaagatctacaagaccccctacgtgcccatagacaaggaggtgaagatagacagcttctacatgcgcatggcgctaaaggtgctgaccctgagcgacgacctgggagtgtaccgcaacgagcgcatccacaaggccgtgagcgccagccggcggcgcgagctgagcgaccgcgagctgatgcacagtctgcaacgcgcgctgaccggcgcgggcgagggcgacagggaggtcgagtcctacttcgacatgggggccgacctgcactggcagccgagccgccgcgccctggaggcggcgggggcgtatggcggccccctggcggccgatggcgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcggacgaggccggactggtgtacgatgcgctgctgcagcgggtggcgcggtacaacagcggcaacgtgcaaaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaacttcttgagcgcgctgcggctgatggtgaccgaggtccctcagagcgaagtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggactttgaggtgcccgaggtcaacgacgggttcctctgggatgacatggatgacagtgtgttctcccccaacccgctgcgcgccgcgtctctgcgattgaaggagggctctgacagggaaggaccgaggagtttggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctacagcccgtgagggacaaaaacgctcagcggcagcagtttcccaacaacgggatagagagcctggtggacaagatgtccagatggaagacgtatgcgcaggagtacaaggagtgggaggaccgacagccgcggcccctgccgccccctagacagcgctggcagcggcgtgcgtccaaccgccgctggaggcaggggcccgaggacgatgatgactctgcagatgacagcagcgtgttggatctgggcgggagcgggaaccccttttcgcacctgcgcccacgcctgggcaagatgttttaaaagagaaaaataaaaactcaccaaggccatggcgacgagcgttggtttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactattcagagaccatgactctcgacctgatgaacaatgcgatcgtggaacactatctgaaagtgggcaggcagaacggggtgaaggagagcgatatcggggtcaagtttgacaccagaaactttcgtctgggctgggaccccgtgaccgggctggtcatgccgggggtctacaccaacgaggcctttcatcccgatatagtgctcctgcccggctgtggggtggactttacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggtggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcgactgaagcagttaaggaaaaggcccaggcagagcaggaagagaaaaaacctgtcattcaacctctaaaagaagatagcaaaaagcgcagttacaacgtcatcgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtgcactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctaccctcacgctccaaaatcatgtccgtactcatctcgcccagcaacaacaccggctgggggctgcgcgcgcccagcaagatgtttggaggggcgaggaaacgctccgaacagcacccagtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtaagcggcacacgggtgcccgtgcgctttcgccccccacggaattagcacaaaacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgacgttgacgaggcggtggagtttgtccgccgcatggcgcccaggcgccccgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgctttggggagtttgcatatgggaaacggccccgcgagagcctaaaagaggacctgctggcgctaccgctggacgagggcaatcccaccccgagtctgaagccggtaaccctgcaacaggtgctgcctttgagcgcgcccagcgagcagaagcgagggttgaagcgcgagggcggggacctggcacccaccgtgcagttgatggtgcccaagcggcagaagctggaggacgtgctggagaaaatgaaagtagagcccgggatccagcccgaaatcaaggtccgccccatcaagcaggtggcgcccggcgtgggagtccagaccgtggacgttaggattcccacggaggagatggaaacccaaaccgccactccctcttcggcggctagcgccaccaccggcgccgcttcggtagaggtgcagacggacccctggctacctgccgccactgtcgccgccgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcacccgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcattgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaagagcaggcgcatgcgcggcggtgtgctgcccttcctaatcccgctaatcgccgcggcgatcggtgccgtgcccgggatcgcctccgtggccctgcaggcgtcccagaaacattgactcttgcaaccttgcaagcttgcattttttggaggaaaaaataaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagtggccttaaaaattttggttccaccattaagaactatggcaacaaagcgtggaacagcagcacgggccagatgctgagagacaagttgaaagagcagaacttccaggaaaaggtggcgcagggcctggcctctggcatcagcggggtggtggacatagctaaccaggccgtgcagaaaaagataaacagtcatctggacccccggcctcaggtggaggaaacgcctccagcaatggagacggtgtctcccgagggcaaaggcgaaaagcgcccgcggcccgacagggaagagaccctggtgtcacacaccgaggagccgccctcttacgaggaggcagtcaaggccggcctgcctaccactcgccccatagcccccatggccaccggtgtggtgggacacaggcaacacacccccgcaacactagatctgcccccgccgtccgatccgcctcgccagccaaaggcggcgacggtgtccgctccctccacttccgccgccaacagagtgcccctgcgccgcgctgcaagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggtttatccccgtggatcgggaggacaccgcctactcttacaaggcgcggtttacgctggccgtgggcgacaatcgcgtgctggacatggcctccacttactttgacatccggggggtgctggacaggggtcccacttttaagccctactcgggcactgcctacaaccccctggctcctaagggcgcccccaattcttgtgagtgggaacaagaggaaaaccaggtggtcgctgcagatgatgaacttgaggatgaggaagcgcaggcacaagaggaagcccctgtgaaaaaaattcatgtgtatgctcaggcgcctctttccggcgaaaagatttccaaggatggcatccaaataggcactgaagtcgtaggagatacatctaaggacacttttgccgacaaaacattccagcccgaacctcagataggcgaatctcagtggaatgaagctgatgccacagcagcaggaggtagggttttgaagaagactactcccatgaggccttgttatggatcttatgctaggcctaccaatgccaacggaggccaaggaattatggttgccaatgaacaaggagtgttggagtctaaagtagaaatgcagtttttctctaacaccacaacccttaatgcgcgggatggaaccggcaatcccgaaccaaaggtggtgttgtatagtgaagatgtccacttggaatctcccgatactcacctgtcttacaagcccaaaaaggatgatgttaatgccaaaatcatgttgggccaacaggctatgcccaataggcccaatcttattggatttagagataatttcattgggctcatgttttacaacagcaccggtaacatgggagtgctggcgggtcaagcctctcagttgaatgctgtggtggacttgcaggatagaaacacagaactgtcgtatcagcttttgcttgattccattggggatagaaccagatatttctccatgtggaaccaggcagtggatagttatgacccagatgtcagaatcattgaaaaccacgggactgaggacgaactgcctaactactgttttcctctgggcggcattggagttacagatacttatcaagggataaaaaatactaatggcaatggtcaatggaccaaagatgatcagtttgcggaccgcaatgaaataggggtgggaaacaactttgccatggagatcaacatccaggccaacctctggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcacccactatgcgcgagggacaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgactttcgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgcctgcatgactggttccaccgagcaagagctcagggccatcgccagagacctgggatgcggaccctactttttgggcacctatgacaaacgcttcccgggtttcatctcccgagacaagctcgcctgcgccatcgtcaacacggccgcgcgcgagaccgggggcgtgcactggctggcctttggctgggacccgcgctctaaaacttgctacctctttgacccctttggcttctctgatcagcgcctcaggcagatttatgagtttgagtacgaggggctgctgcgccgcagcgcgcttgcctcctcgcccgaccgctgcatcacccttgagaagtccaccgagaccgtgcaggggccccactcggccgcctgcggtctcttctgttgcatgtttttgcacgcctttgtacactggcctcagagtcccatggatcgcaaccccaccatgaacttgctaaagggagtgcccaacgccatgctccagagcccccaggtcctgcccaccctgcgccgcaaccaggaacagctctaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaaattctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactgattcgcgggacagctggcatcgtgcaggcagcagcgcgcgtcagtgttggcgatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatagtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggcaccagggcctcgtcgccctcggactcttcctctgactccaggcggcggcggagtcgcttctttgggggcgcgcgcgtcagcggcggcggagacggggacggggacggggacgggacgccctccacagggggcggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctctgagaccgccgtcgccgtcgcccccgctaccgccgacgcgcccgccacaccgagcgacacccccgcggacccccccgccgacgcacccctgttcgaggaagcggccgtggagcaggacccgggctttgtctcggcagaggaggatttgcaagaggaggaggataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtaccaaagatcttcgagggtctgggtcgcaacgaaaagcgggcagcaaactctctgcaacaggaaaacagcgaaaatgagagtcacaccggggtgctggtggagctcgagggcgacaacgcccgcctggcggtgctcaagcgcagcatcgaggtcacccactttgcctaccccgcgctcaacctgccccccaaagtcatgaacgcggtcatggacgggctgatcatgcgccgcggccagccccttgctccagatgcaaacttgcatgaggagaccgaggacggccagcccgtggtcagcgacgagcagctggcgcgctggctggaaaccgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgagaaccgccttgggcagagcgtgctgcactccaccctgcgcggggaagcgcgccgcgactacgtgcgcgactgcgtttaccttttcctctgctacacctggcagacggccatgggggtctggcagcagtgcctggaggagcgcaacctcaaggagctggagaagctcctgcagcgcgcgctcaaagacctctggacgggcttcaacgagcgctcggtggccgccgcgctggccgacctcatcttccccgagcgcctgctcaaaactctccagcaggggctgcccgacttcaccagccaaagcatgttgcaaaactttaggaactttatcctggagcgttctggcatcctacccgccacctgctgcgccctgcccagtgactttgttcccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagagtttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggagtactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggaaaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccggcggcagcggcgcccgtttcggtgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcacacggggtgcgctttttcatcccgagtcaggtccgctctaccctaatcagggagtttacagcccgtcccctactggcggagttggaaaaggggccttctatcctaaccattgcctgcatctgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggtccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgagaccctacccaacgaatcgggattgaatatcggtaaccaggttgcagtttcacttttgattacctttatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactatcctaatcaaatgtgttactcaacacgataaggtaactgttaaatacaaagatcaattaaaaaaagacgcactttacagcagctggcaaccaggagatgaacaaaaatacaatgtaaccgtcttccagggcaaactctccaaaacttacaattacactttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatatcagatttaaatcaaggcaaagctttattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatgattaattactggagaccccacagagattacatgcttcacgtagtaaagggtcccattagcagcccaaccaccacctctaccacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagagtcagaagcgctgccggtggccctaaaacagtatgcagacccccacaccacccccgaccttcctccaccttcccagaagccaagtttcctgggggaaaatgaaactctgcctctctccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagcctctgtccaattttttcagcaacacttccttcccctcttcccaactctggtactctaggcgcctcctagctgcaaacttcctccacagtctgaagggaatgtcagattcctcctcctcctgtccctccgcacccacaatcttcatgttgttgcagatgaaacgcgcgagatcgtctgacgagaccttcaaccccgtgtacccctacgataccgagatcgctccgacttctgtccctttccttacccctccctttgtgtcacccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagaggctcccctgcatgcaagtgacagcagtagcctgggccttagcgtcacggccccacttagcattaacaatgacagcctaggactagatctgcaggcacccattgtctctcaaaatggaaaactggctctaaatatagcaggccccctagctgtagccgatagcattaatgctttgacagtaggcactggcaaaggtattggactaaatgaaaccagcactcacttgcaagcaaaattggttgcccccctaggctttgataccaatggcaatattaagctaagcgttgcaggaggcatgaggctaaacaatgacacactgatactagatgtaaactacccatttgaagctcaaggtcaactaagcctaagagtgggcacaggtccactgtatgtagattctagcagtcataatctaaccattagatgccttaggggattgtatataacatcatctaacaaccaaaacggtctagaggccaacattaaactaacaaaaggccttgtgtatgaaggaaatgccatagcagttaatgttggtcaaggattgcaatacagcactactgccacatcggaaggtgtgtatcctatacagtctaagataggtttgggaatggaatatgataccaacggagccatgatggcaaaactaggctccggtctaagctttgataattcaggagccattgtggtgggaaacaaaaatgatgacaaacttaccctatggaccacacctgacccgtctcctaactgtagaatttattctgaaaaagatactaaactaaccttggtgctgactaagtgtggcagtcaaatcctaggcacagtatctgcccttgctgtcagaggcagccttgcgcccatcactaacgcatccagcatagtccaaatatttctacgatttgatgaaaatggactattgatgagcaactcatcgctagacggtgattactggaattacagaaatggggactccactaatggcacaccatatacaaatgcagtaggctttatgcctaatctagctgcctatcctaaaggtcaggctacaactgcaaaaagcagtattgtaagccaggtatacatggatggtgatactactaaacctataacactaaaaataaactttaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgtttttgatttcaaaattgtgtgcttttatttattttcaagcttacagtatttccagtagtcattcaaatagagcttaatgaaactgcatgagaacccttccacatagcttaaattatcaccagtgcaaatggagaaaaaatcaacatacctttttatccagatatcatagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcagtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgctgcaacaaggcgcgcagcaactcctgccgccgcctttccgtacgacaggaatgcaacggggtggtggtctcctccgcgataatccgcaccgctcgcaacatcagcgtcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcataccagatcctcaggtaaatcaaatgacgacctctcatgaacacgctggacatgtacatcacctccttaggcatgtgctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccttgcgtcttctgtctcgccgcctgccccgctcggtgtagtagttgtaatacagccactccctcagaccgtcaaggcgctccctggcgtccggatctataacaacaccatcctgcagcgccgccctgatgacatccaccaccgtagagtatgccaagcccagccaggaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaataaaaaagaaacattacacaagagtagcctgtcttacaatgggatagactactctaaccaacataagacgggccacaacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatatagcgcttccacagcagccatgacaaaagactcaaaacactcaaaagactcagtcttaccaggaaaataaaagcactctcacagcaccagcactaatcagagtgtgaaaaaggccaagtgccgaacgagtatatataggaattaaaaatgacgtaaatgtgtaaaggtcagaaaacgcccagaaaaatacacagaccaacgcccgaaacgaaaacccgcgaaaaaatacccagaagttcctcaacaaccgccacttccgctttcccacgagacgtcacttcctcaaaaatagcaaactacatttcccacatatacaaaaccaaaacccctccccttgtcaccgcccacaacttacatcatcacaaacgtcaaagcctacgtcacccgccccgcccacctcattatcatattggccacaatccaaaataaggtatattattgatgatg

SEQ ID NO: 4 - DNA, 37169 bp, Great Ape Adenovirus
catcatcaataatataccttattttggattgtggccaatatgataatgaggtgggcggggcgggtgacgtaggacgcgcgagtagggttgggaggtgtgcggaagtgtggcatttgcaagtgggaggagctcacatgtaagcttccgtcgcggaaaatgtgacgtttttaatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatctgacgcggagggtatttaaacccgctgcgctcctaaagaggccactcttgagtgccagcgagaagagttttctcctccgctccgtttcggcgatcgaaaaatgagacacttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggccgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcagggcaaggaaattaccttccattttgtgcaagcctaagacacctgtgaggaccagcgaggcggacagcactgactctggcacttctacctctcctcctgaaattcacccagtggttcctttgggtatacataaacctgttgctattagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtctccagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagtcggaggagcgagcggagaagatcagcttgagagccggcctggaccctcctcaggaggaatgaatctcccgcaggtggttgacctgtttcccgaactgagacgggtcctgactatcagggaagatggtcagtttgtgaagaagctgaagagggatcggggtgagggagatgatgaggcggctagcaatttagcttttagtctgataacccgccaccgaccggaatgtattacctatcagcagattaaggagagttgtgccaacgagctggatcttttgggtcagaagtatagcatagaacagcttaccacttactggcttcagcccggggatgattgggaagaggcgatcagggtgtatgcaaaggtggccctgcggcccgattgcaagtataagattactaagttggttaatattagaaactgctgctatatttctgggaacggggccgaagtggagatagatactgaggacagggtggctattaggtgttgcatgataaacatgtggcccgggatactggggatggatggggtgatatttatgaatgtaaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaacttcagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagcccctatctgacagtgcgcatgcctcactgggccggagtgcgtcagaatgtgatgggttccaacgtggatggacgtcccgttctgccttcaaattcgtctacgatggcctacgcgaccgtgggaggaactccgttggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagctgggaggggtgcatccggggggatatgatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttttccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagagtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggctgcccccatgctttttgatgcgtttcttacctcggctctccatgaggcggtgtcccttctcggtgacgaagaggctgtccgtgtccccgtagaccgatttcaggggcctgtcttccagcggagtgcctctgtcctcctcgtagagaaactctgaccactctgagacaaaggcccgtgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggtgccctttcatcttcactctcttccgcatcgctgtctgcgagagccagctgctggggtaagtattccctttcgaaggcgggcatgacctcagcgctcaggttgtcagtttctaaaaatgaggaagatttgatgttcacctgtccggaggtgatacctttgagggtacctgggtctatctggtcagaaaacactatttttttgttatcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagccgcggttgtgcagggtgaccatgtcgacgctggtggcgacctcaccgcgcaggcgctcgttggtccagcagaggcggccgcccttgcgcgagcagaaggggggtagggggtccagctggtcctcgttcggggggtccgcgtcgatggtaaagaccccggggagcagacgcgggtcaaagtagtcgatcttgcaagcttgcatgtccagagcccgctgccattcgcgggcggcgagcgcgcgctcgtaggggttgaggggcgggccccagggcatggggtgggtgagcgcagaggcgtacatgccgcagatgtcatacacgtacaggggttccctgaggatgccgaggtaggtggggtagcagcgccccccgcggatgctggcgcgcacgtagtcatagagttcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcacggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaggaagcggggctggcccttgatggaggggagctttttaagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcaatagaaggtgagggggtctttctcccaggggtcccatctgagctctcgggcgaggtcgcgtgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggtttacctcgcagagacgggtcaacgcacgggcagtgttaagatggtatctgatttcaaggggcgtgttggcggcggagtcgatggcttgcaggaggccgcagccccggggggccacgatggttccccgtggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacaaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctttcatctcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcctctccccgccccggtcaccacggccgcggcggccgtgtccggcgcggggggtgcgctggagtcagatgagccaccgcggcggcgacctaggcagtatctggacttggaagagggcgagggactggcgcggctgggggcgagctccccagagcgtcacccgcgggtgcagttgaaaagggacgcgcgcgaggcgtacctgccgcggcaaaacctgtttcgcgaccgcgggggcgaggagcccgaggagatgcgagactgcaggttccaagcagggcgcgagctgcgccgcggcttggacagagagcgcttgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgatgccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgcccgcaagatctacaagaccccctacgtgcccatagacaaggaggtgaagatagacagcttctacatgcgcatggcgctaaaggtgctgaccctgagcgacgacctgggagtgtaccgcaacgagcgcatccacaaggccgtgagcgccagccggcggcgcgagctgagcgaccgcgagctgatgcacagtctgcaacgcgcgctgaccggcgcgggcgagggcgacagggaggtcgagtcctacttcgacatgggggccgacctgcactggcagccgagccgccgcgccctggaggcggcgggggcgtatggcggccccctggcggccgatggcgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcggacgaggccggactggtgtacgatgcgctgctgcagcgggtggcgcggtacaacagcggcaacgtgcaaaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaacttcttgagcgcgctgcggctgatggtgaccgaggtccctcagagcgaagtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggactttgaggtgcccgaggtcaacgacgggttcctctgggatgacatggatgacagtgtgttctcccccaacccgctgcgcgccgcgtctctgcgattgaaggagggctctgacagggaaggaccgaggagtttggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctacagcccgtgagggacaaaaacgctcagcggcagcagtttcccaacaacgggatagagagcctggtggacaagatgtccagatggaagacgtatgcgcaggagtacaaggagtgggaggaccgacagccgcggcccctgccgccccctagacagcgctggcagcggcgtgcgtccaaccgccgctggaggcaggggcccgaggacgatgatgactctgcagatgacagcagcgtgttggatctgggcgggagcgggaaccccttttcgcacctgcgcccacgcctgggcaagatgttttaaaagagaaaaataaaaactcaccaaggccatggcgacgagcgttggtttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactattcagagaccatgactctcgacctgatgaacaatgcgatcgtggaacactatctgaaagtgggcaggcagaacggggtgaaggagagcgatatcggggtcaagtttgacaccagaaactttcgtctgggctgggaccccgtgaccgggctggtcatgccgggggtctacaccaacgaggcctttcatcccgatatagtgctcctgcccggctgtggggtggactttacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggtggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcgactgaagcagttaaggaaaaggcccaggcagagcaggaagagaaaaaacctgtcattcaacctctaaaagaagatagcaaaaagcgcagttacaacgtcatcgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtgcactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctaccctcacgctccaaaatcatgtccgtactcatctcgcccagcaacaacaccggctgggggctgcgcgcgcccagcaagatgtttggaggggcgaggaaacgctccgaacagcacccagtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtaagcggcacacgggtgcccgtgcgctttcgccccccacggaattagcacaaaacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgacgttgacgaggcggtggagtttgtccgccgcatggcgcccaggcgccccgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgctttggggagtttgcatatgggaaacggccccgcgagagcctaaaagaggacctgctggcgctaccgctggacgagggcaatcccaccccgagtctgaagccggtaaccctgcaacaggtgctgcctttgagcgcgcccagcgagcagaagcgagggttgaagcgcgagggcggggacctggcacccaccgtgcagttgatggtgcccaagcggcagaagctggaggacgtgctggagaaaatgaaagtagagcccgggatccagcccgaaatcaaggtccgccccatcaagcaggtggcgcccggcgtgggagtccagaccgtggacgttaggattcccacggaggagatggaaacccaaaccgccactccctcttcggcggctagcgccaccaccggcgccgcttcggtagaggtgcagacggacccctggctacctgccgccactgtcgccgccgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcacccgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcattgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaagagcaggcgcatgcgcggcggtgtgctgcccttcctaatcccgctaatcgccgcggcgatcggtgccgtgcccgggatcgcctccgtggccctgcaggcgtcccagaaacattgactcttgcaaccttgcaagcttgcattttttggaggaaaaaataaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagtggccttaaaaattttggttccaccattaagaactatggcaacaaagcgtggaacagcagcacgggccagatgctgagagacaagttgaaagagcagaacttccaggaaaaggtggcgcagggcctggcctctggcatcagcggggtggtggacatagctaaccaggccgtgcagaaaaagataaacagtcatctggacccccggcctcaggtggaggaaacgcctccagcaatggagacggtgtctcccgagggcaaaggcgaaaagcgcccgcggcccgacagggaagagaccctggtgtcacacaccgaggagccgccctcttacgaggaggcagtcaaggccggcctgcctaccactcgccccatagcccccatggccaccggtgtggtgggacacaggcaacacacccccgcaacactagatctgcccccgccgtccgatccgcctcgccagccaaaggcggcgacggtgtccgctccctccacttccgccgccaacagagtgcccctgcgccgcgctgcaagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggtttatccccgtggatcgggaggacaccgcctactcttacaaggcgcggtttacgctggccgtgggcgacaatcgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggaggctgcagatgaggacgtcgaagatgaagaagcgcaagcacaagaggaagcccctgttaaaaaaattcatgtatatgctcaggcgcctcttgctggcgaaaagattaccaaggatggtttgcaaataggtactgaagtcgtaggagagacatctaaggacacttttgcagataaaacattccaacccgaacctcagataggcgagtctcagtggaacgaggctgatgccgcagtagcaggaggtagagttttgaaaaagactacccctatgagaccttgctatggatcctatgccaggcctaccaatgccaacgggggtcaaggaattctggttgccaatgaacaaggagtgatggagtctaaagtagaaatgcaatttttctctaacacctcaacccttaatgcgcgggatggaaccggcaatcccgaaccaaaggtggtgttgtacagcgaagatgtccacttggaatctcccgatactcatctgtcttacaagcccaaaaaggatgatgttaatgccaaagtcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatggggttgaggatgaactgcccaactactgcttccctttgggcggcataggaattactgatacttatcaaggggtgaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgactttcgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgcctgcatgactggttccaccgagcaagagctcagggccatcgccagagacctgggatgcggaccctactttttgggcacctatgacaaacgcttcccgggtttcatctcccgagacaagctcgcctgcgccatcgtcaacacggccgcgcgcgagaccgggggcgtgcactggctggcctttggctgggacccgcgctctaaaacttgctacctctttgacccctttggcttctctgatcagcgcctcaggcagatttatgagtttgagtacgaggggctgctgcgccgcagcgcgcttgcctcctcgcccgaccgctgcatcacccttgagaagtccaccgagaccgtgcaggggccccactcggccgcctgcggtctcttctgttgcatgtttttgcacgcctttgtacactggcctcagagtcccatggatcgcaaccccaccatgaacttgctaaagggagtgcccaacgccatgctccagagcccccaggtcctgcccaccctgcgccgcaaccaggaacagctctaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaaattctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactgattcgcgggacagctggcatcgtgcaggcagcagcgcgcgtcagtgttggcgatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatagtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggcaccagggcctcgtcgccctcggactcttcctctgactccaggcggcggcggagtcgcttctttgggggcgcgcgcgtcagcggcggcggagacggggacggggacggggacgggacgccctccacagggggcggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctctgagaccgccgtcgccgtcgcccccgctaccgccgacgcgcccgccacaccgagcgacacccccgcggacccccccgccgacgcacccctgttcgaggaagcggccgtggagcaggacccgggctttgtctcggcagaggaggatttgcaagaggaggaggataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtaccaaagatcttcgagggtctgggtcgcaacgaaaagcgggcagcaaactctctgcaacaggaaaacagcgaaaatgagagtcacaccggggtgctggtggagctcgagggcgacaacgcccgcctggcggtgctcaagcgcagcatcgaggtcacccactttgcctaccccgcgctcaacctgccccccaaagtcatgaacgcggtcatggacgggctgatcatgcgccgcggccagccccttgctccagatgcaaacttgcatgaggagaccgaggacggccagcccgtggtcagcgacgagcagctggcgcgctggctggaaaccgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgagaaccgccttgggcagagcgtgctgcactccaccctgcgcggggaagcgcgccgcgactacgtgcgcgactgcgtttaccttttcctctgctacacctggcagacggccatgggggtctggcagcagtgcctggaggagcgcaacctcaaggagctggagaagctcctgcagcgcgcgctcaaagacctctggacgggcttcaacgagcgctcggtggccgccgcgctggccgacctcatcttccccgagcgcctgctcaaaactctccagcaggggctgcccgacttcaccagccaaagcatgttgcaaaactttaggaactttatcctggagcgttctggcatcctacccgccacctgctgcgccctgcccagtgactttgttcccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagagtttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggagtactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggaaaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccggcggcagcggcgcccgtttcggtgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcacacggggtgcgctttttcatcccgagtcaggtccgctctaccctaatcagggagtttacagcccgtcccctactggcggagttggaaaaggggccttctatcctaaccattgcctgcatctgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggtccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgagaccctacccaacgaatcgggattgaatatcggtaaccaggttgcagtttcacttttgattacctttatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactatcctaatcaaatgtgttactcaacacgataaggtaactgttaaatacaaagatcaattaaaaaaagacgcactttacagcagctggcaaccaggagatgaacaaaaatacaatgtaaccgtcttccagggcaaactctccaaaacttacaattacactttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatatcagatttaaatcaaggcaaagctttattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatgattaattactggagaccccacagagattacatgcttcacgtagtaaagggtcccattagcagcccaaccaccacctctaccacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagagtcagaagcgctgccggtggccctaaaacagtatgcagacccccacaccacccccgaccttcctccaccttcccagaagccaagtttcctgggggaaaatgaaactctgcctctctccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagcctctgtccaattttttcagcaacacttccttcccctcttcccaactctggtactctaggcgcctcctagctgcaaacttcctccacagtctgaagggaatgtcagattcctcctcctcctgtccctccgcacccacaatcttcatgttgttgcagatgaaacgcgcgagatcgtctgacgagaccttcaaccccgtgtacccctacgataccgagatcgctccgacttctgtccctttccttacccctccctttgtgtcacccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagaggctcccctgcatgcaagtgacagcagtagcctgggccttagcgtcacggccccacttagcattaacaatgacagcctaggactagatctgcaggcacccattgtctctcaaaatggaaaactggctctaaatatagcaggccccctagctgtagccgatagcattaatgctttgacagtaggcactggcaaaggtattggactaaatgaaaccagcactcacttgcaagcaaaattggttgcccccctaggctttgataccaatggcaatattaagctaagcgttgcaggaggcatgaggctaaacaatgacacactgatactagatgtaaactacccatttgaagctcaaggtcaactaagcctaagagtgggcacaggtccactgtatgtagattctagcagtcataatctaaccattagatgccttaggggattgtatataacatcatctaacaaccaaaacggtctagaggccaacattaaactaacaaaaggccttgtgtatgaaggaaatgccatagcagttaatgttggtcaaggattgcaatacagcactactgccacatcggaaggtgtgtatcctatacagtctaagataggtttgggaatggaatatgataccaacggagccatgatggcaaaactaggctccggtctaagctttgataattcaggagccattgtggtgggaaacaaaaatgatgacaaacttaccctatggaccacacctgacccgtctcctaactgtagaatttattctgaaaaagatactaaactaaccttggtgctgactaagtgtggcagtcaaatcctaggcacagtatctgcccttgctgtcagaggcagccttgcgcccatcactaacgcatccagcatagtccaaatatttctacgatttgatgaaaatggactattgatgagcaactcatcgctagacggtgattactggaattacagaaatggggactccactaatggcacaccatatacaaatgcagtaggctttatgcctaatctagctgcctatcctaaaggtcaggctacaactgcaaaaagcagtattgtaagccaggtatacatggatggtgatactactaaacctataacactaaaaataaactttaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgtttttgatttcaaaattgtgtgcttttatttattttcaagcttacagtatttccagtagtcattcaaatagagcttaatgaaactgcatgagaacccttccacatagcttaaattatcaccagtgcaaatggagaaaaaatcaacatacctttttatccagatatcatagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcagtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgctgcaacaaggcgcgcagcaactcctgccgccgcctttccgtacgacaggaatgcaacggggtggtggtctcctccgcgataatccgcaccgctcgcaacatcagcgtcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcataccagatcctcaggtaaatcaaatgacgacctctcatgaacacgctggacatgtacatcacctccttaggcatgtgctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccttgcgtcttctgtctcgccgcctgccccgctcggtgtagtagttgtaatacagccactccctcagaccgtcaaggcgctccctggcgtccggatctataacaacaccatcctgcagcgccgccctgatgacatccaccaccgtagagtatgccaagcccagccaggaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaataaaaaagaaacattacacaagagtagcctgtcttacaatgggatagactactctaaccaacataagacgggccacaacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatatagcgcttccacagcagccatgacaaaagactcaaaacactcaaaagactcagtcttaccaggaaaataaaagcactctcacagcaccagcactaatcagagtgtgaaaaaggccaagtgccgaacgagtatatataggaattaaaaatgacgtaaatgtgtaaaggtcagaaaacgcccagaaaaatacacagaccaacgcccgaaacgaaaacccgcgaaaaaatacccagaagttcctcaacaaccgccacttccgctttcccacgagacgtcacttcctcaaaaatagcaaactacatttcccacatatacaaaaccaaaacccctccccttgtcaccgcccacaacttacatcatcacaaacgtcaaagcctacgtcacccgccccgcccacctcattatcatattggccacaatccaaaataaggtatattattgatgatg

SEQ ID NO: 5 - DNA, 37184 bp, Great Ape Adenovirus
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggaggctgcagatgaggacgtcgaagatgaagaagcgcaagcacaagaggaagcccctgttaaaaaaattcatgtatatgctcaggcgcctcttgctggcgaaaagattaccaaggatggtttgcaaataggtactgaagtcgtaggagagacatctaaggacacttttgcagataaaacattccaacccgaacctcagataggcgagtctcagtggaacgaggctgatgccgcagtagcaggaggtagagttttgaaaaagactacccctatgagaccttgctatggatcctatgccaggcctaccaatgccaacgggggtcaaggaattctggttgccaatgaacaaggagtgatggagtctaaagtagaaatgcaatttttctctaacacctcaacccttaatgcgcgggatggaaccggcaatcccgaaccaaaggtggtgttgtacagcgaagatgtccacttggaatctcccgatactcatctgtcttacaagcccaaaaaggatgatgttaatgccaaagtcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatggggttgaggatgaactgcccaactactgcttccctttgggcggcataggaattactgatacttatcaaggggtgaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 6 - DNA, 37172 bp, Great Ape Adenovirus
catcatcaataatataccttattttggattgtggccaatatgataatgaggtgggcggggcgggtgacgtaggacgcgcgagtagggttgggaggtgtgcggaagtgtggcatttgcaagtgggaggagctcacatgtaagcttccgtcgcggaaaatgtgacgtttttaatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatctgacgcggagggtatttaaacccgctgcgctcctaaagaggccactcttgagtgccagcgagaagagttttctcctccgctccgtttcggcgatcgaaaaatgagacacttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggccgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcagggcaaggaaattaccttccattttgtgcaagcctaagacacctgtgaggaccagcgaggcggacagcactgactctggcacttctacctctcctcctgaaattcacccagtggttcctttgggtatacataaacctgttgctattagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtctccagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagtcggaggagcgagcggagaagatcagcttgagagccggcctggaccctcctcaggaggaatgaatctcccgcaggtggttgacctgtttcccgaactgagacgggtcctgactatcagggaagatggtcagtttgtgaagaagctgaagagggatcggggtgagggagatgatgaggcggctagcaatttagcttttagtctgataacccgccaccgaccggaatgtattacctatcagcagattaaggagagttgtgccaacgagctggatcttttgggtcagaagtatagcatagaacagcttaccacttactggcttcagcccggggatgattgggaagaggcgatcagggtgtatgcaaaggtggccctgcggcccgattgcaagtataagattactaagttggttaatattagaaactgctgctatatttctgggaacggggccgaagtggagatagatactgaggacagggtggctattaggtgttgcatgataaacatgtggcccgggatactggggatggatggggtgatatttatgaatgtaaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaacttcagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagcccctatctgacagtgcgcatgcctcactgggccggagtgcgtcagaatgtgatgggttccaacgtggatggacgtcccgttctgccttcaaattcgtctacgatggcctacgcgaccgtgggaggaactccgttggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagctgggaggggtgcatccggggggatatgatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttttccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagagtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggctgcccccatgctttttgatgcgtttcttacctcggctctccatgaggcggtgtcccttctcggtgacgaagaggctgtccgtgtccccgtagaccgatttcaggggcctgtcttccagcggagtgcctctgtcctcctcgtagagaaactctgaccactctgagacaaaggcccgtgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggtgccctttcatcttcactctcttccgcatcgctgtctgcgagagccagctgctggggtaagtattccctttcgaaggcgggcatgacctcagcgctcaggttgtcagtttctaaaaatgaggaagatttgatgttcacctgtccggaggtgatacctttgagggtacctgggtctatctggtcagaaaacactatttttttgttatcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagccgcggttgtgcagggtgaccatgtcgacgctggtggcgacctcaccgcgcaggcgctcgttggtccagcagaggcggccgcccttgcgcgagcagaaggggggtagggggtccagctggtcctcgttcggggggtccgcgtcgatggtaaagaccccggggagcagacgcgggtcaaagtagtcgatcttgcaagcttgcatgtccagagcccgctgccattcgcgggcggcgagcgcgcgctcgtaggggttgaggggcgggccccagggcatggggtgggtgagcgcagaggcgtacatgccgcagatgtcatacacgtacaggggttccctgaggatgccgaggtaggtggggtagcagcgccccccgcggatgctggcgcgcacgtagtcatagagttcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcacggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaggaagcggggctggcccttgatggaggggagctttttaagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcaatagaaggtgagggggtctttctcccaggggtcccatctgagctctcgggcgaggtcgcgtgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggtttacctcgcagagacgggtcaacgcacgggcagtgttaagatggtatctgatttcaaggggcgtgttggcggcggagtcgatggcttgcaggaggccgcagccccggggggccacgatggttccccgtggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacaaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctttcatctcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcctctccccgccccggtcaccacggccgcggcggccgtgtccggcgcggggggtgcgctggagtcagatgagccaccgcggcggcgacctaggcagtatctggacttggaagagggcgagggactggcgcggctgggggcgagctccccagagcgtcacccgcgggtgcagttgaaaagggacgcgcgcgaggcgtacctgccgcggcaaaacctgtttcgcgaccgcgggggcgaggagcccgaggagatgcgagactgcaggttccaagcagggcgcgagctgcgccgcggcttggacagagagcgcttgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgatgccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgcccgcaagatctacaagaccccctacgtgcccatagacaaggaggtgaagatagacagcttctacatgcgcatggcgctaaaggtgctgaccctgagcgacgacctgggagtgtaccgcaacgagcgcatccacaaggccgtgagcgccagccggcggcgcgagctgagcgaccgcgagctgatgcacagtctgcaacgcgcgctgaccggcgcgggcgagggcgacagggaggtcgagtcctacttcgacatgggggccgacctgcactggcagccgagccgccgcgccctggaggcggcgggggcgtatggcggccccctggcggccgatggcgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcggacgaggccggactggtgtacgatgcgctgctgcagcgggtggcgcggtacaacagcggcaacgtgcaaaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaacttcttgagcgcgctgcggctgatggtgaccgaggtccctcagagcgaagtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggactttgaggtgcccgaggtcaacgacgggttcctctgggatgacatggatgacagtgtgttctcccccaacccgctgcgcgccgcgtctctgcgattgaaggagggctctgacagggaaggaccgaggagtttggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctacagcccgtgagggacaaaaacgctcagcggcagcagtttcccaacaacgggatagagagcctggtggacaagatgtccagatggaagacgtatgcgcaggagtacaaggagtgggaggaccgacagccgcggcccctgccgccccctagacagcgctggcagcggcgtgcgtccaaccgccgctggaggcaggggcccgaggacgatgatgactctgcagatgacagcagcgtgttggatctgggcgggagcgggaaccccttttcgcacctgcgcccacgcctgggcaagatgttttaaaagagaaaaataaaaactcaccaaggccatggcgacgagcgttggtttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactattcagagaccatgactctcgacctgatgaacaatgcgatcgtggaacactatctgaaagtgggcaggcagaacggggtgaaggagagcgatatcggggtcaagtttgacaccagaaactttcgtctgggctgggaccccgtgaccgggctggtcatgccgggggtctacaccaacgaggcctttcatcccgatatagtgctcctgcccggctgtggggtggactttacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggtggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcgactgaagcagttaaggaaaaggcccaggcagagcaggaagagaaaaaacctgtcattcaacctctaaaagaagatagcaaaaagcgcagttacaacgtcatcgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtgcactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctaccctcacgctccaaaatcatgtccgtactcatctcgcccagcaacaacaccggctgggggctgcgcgcgcccagcaagatgtttggaggggcgaggaaacgctccgaacagcacccagtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtaagcggcacacgggtgcccgtgcgctttcgccccccacggaattagcacaaaacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgacgttgacgaggcggtggagtttgtccgccgcatggcgcccaggcgccccgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgctttggggagtttgcatatgggaaacggccccgcgagagcctaaaagaggacctgctggcgctaccgctggacgagggcaatcccaccccgagtctgaagccggtaaccctgcaacaggtgctgcctttgagcgcgcccagcgagcagaagcgagggttgaagcgcgagggcggggacctggcacccaccgtgcagttgatggtgcccaagcggcagaagctggaggacgtgctggagaaaatgaaagtagagcccgggatccagcccgaaatcaaggtccgccccatcaagcaggtggcgcccggcgtgggagtccagaccgtggacgttaggattcccacggaggagatggaaacccaaaccgccactccctcttcggcggctagcgccaccaccggcgccgcttcggtagaggtgcagacggacccctggctacctgccgccactgtcgccgccgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcacccgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcattgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaagagcaggcgcatgcgcggcggtgtgctgcccttcctaatcccgctaatcgccgcggcgatcggtgccgtgcccgggatcgcctccgtggccctgcaggcgtcccagaaacattgactcttgcaaccttgcaagcttgcattttttggaggaaaaaataaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagtggccttaaaaattttggttccaccattaagaactatggcaacaaagcgtggaacagcagcacgggccagatgctgagagacaagttgaaagagcagaacttccaggaaaaggtggcgcagggcctggcctctggcatcagcggggtggtggacatagctaaccaggccgtgcagaaaaagataaacagtcatctggacccccggcctcaggtggaggaaacgcctccagcaatggagacggtgtctcccgagggcaaaggcgaaaagcgcccgcggcccgacagggaagagaccctggtgtcacacaccgaggagccgccctcttacgaggaggcagtcaaggccggcctgcctaccactcgccccatagcccccatggccaccggtgtggtgggacacaggcaacacacccccgcaacactagatctgcccccgccgtccgatccgcctcgccagccaaaggcggcgacggtgtccgctccctccacttccgccgccaacagagtgcccctgcgccgcgctgcaagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggtttatccccgtggatcgggaggacaccgcctactcttacaaggcgcggtttacgctggccgtgggcgacaatcgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgaggacctggaagaagatgaagaagcgcaagcagaagagcaagcccctgttaaaaaaattcatgtatatgctcaggcgcctcttgctggcgaaaagattaccaaggatggtttgcaaataggtactgaagtcgtaggagatacatctaaggacacttttgcagataaaacattccaacccgaacctcagataggcgagtctcagtggaacgaggctgatgccacagcagcaggaggtagagttttgaaaaagactacccctatgagaccttgctatggatcctatgccaggcctaccaatgccaacgggggtcaaggaattatggttgccaatgaacaaggagtgttgcagtctaaagtagaaatgcaatttttctctaacacctcaacccttaatgcgcgggatggaaccggcaatcccgaaccaaaggtggtgttgtacagcgaagatgtccacttggaatctcccgatactcatctgtcttacaagcccaaaaaggatgatgttaatgccaaagtcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatggggttgaggatgaactgcccaactactgcttccctttgggcggcataggaattactgatacttatcaaggggtgaaaaatagcaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgactttcgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgcctgcatgactggttccaccgagcaagagctcagggccatcgccagagacctgggatgcggaccctactttttgggcacctatgacaaacgcttcccgggtttcatctcccgagacaagctcgcctgcgccatcgtcaacacggccgcgcgcgagaccgggggcgtgcactggctggcctttggctgggacccgcgctctaaaacttgctacctctttgacccctttggcttctctgatcagcgcctcaggcagatttatgagtttgagtacgaggggctgctgcgccgcagcgcgcttgcctcctcgcccgaccgctgcatcacccttgagaagtccaccgagaccgtgcaggggccccactcggccgcctgcggtctcttctgttgcatgtttttgcacgcctttgtacactggcctcagagtcccatggatcgcaaccccaccatgaacttgctaaagggagtgcccaacgccatgctccagagcccccaggtcctgcccaccctgcgccgcaaccaggaacagctctaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaaattctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactgattcgcgggacagctggcatcgtgcaggcagcagcgcgcgtcagtgttggcgatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatagtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggcaccagggcctcgtcgccctcggactcttcctctgactccaggcggcggcggagtcgcttctttgggggcgcgcgcgtcagcggcggcggagacggggacggggacggggacgggacgccctccacagggggcggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctctgagaccgccgtcgccgtcgcccccgctaccgccgacgcgcccgccacaccgagcgacacccccgcggacccccccgccgacgcacccctgttcgaggaagcggccgtggagcaggacccgggctttgtctcggcagaggaggatttgcaagaggaggaggataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtaccaaagatcttcgagggtctgggtcgcaacgaaaagcgggcagcaaactctctgcaacaggaaaacagcgaaaatgagagtcacaccggggtgctggtggagctcgagggcgacaacgcccgcctggcggtgctcaagcgcagcatcgaggtcacccactttgcctaccccgcgctcaacctgccccccaaagtcatgaacgcggtcatggacgggctgatcatgcgccgcggccagccccttgctccagatgcaaacttgcatgaggagaccgaggacggccagcccgtggtcagcgacgagcagctggcgcgctggctggaaaccgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgagaaccgccttgggcagagcgtgctgcactccaccctgcgcggggaagcgcgccgcgactacgtgcgcgactgcgtttaccttttcctctgctacacctggcagacggccatgggggtctggcagcagtgcctggaggagcgcaacctcaaggagctggagaagctcctgcagcgcgcgctcaaagacctctggacgggcttcaacgagcgctcggtggccgccgcgctggccgacctcatcttccccgagcgcctgctcaaaactctccagcaggggctgcccgacttcaccagccaaagcatgttgcaaaactttaggaactttatcctggagcgttctggcatcctacccgccacctgctgcgccctgcccagtgactttgttcccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagagtttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggagtactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggaaaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccggcggcagcggcgcccgtttcggtgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcacacggggtgcgctttttcatcccgagtcaggtccgctctaccctaatcagggagtttacagcccgtcccctactggcggagttggaaaaggggccttctatcctaaccattgcctgcatctgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggtccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgagaccctacccaacgaatcgggattgaatatcggtaaccaggttgcagtttcacttttgattacctttatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactatcctaatcaaatgtgttactcaacacgataaggtaactgttaaatacaaagatcaattaaaaaaagacgcactttacagcagctggcaaccaggagatgaacaaaaatacaatgtaaccgtcttccagggcaaactctccaaaacttacaattacactttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatatcagatttaaatcaaggcaaagctttattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatgattaattactggagaccccacagagattacatgcttcacgtagtaaagggtcccattagcagcccaaccaccacctctaccacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagagtcagaagcgctgccggtggccctaaaacagtatgcagacccccacaccacccccgaccttcctccaccttcccagaagccaagtttcctgggggaaaatgaaactctgcctctctccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagcctctgtccaattttttcagcaacacttccttcccctcttcccaactctggtactctaggcgcctcctagctgcaaacttcctccacagtctgaagggaatgtcagattcctcctcctcctgtccctccgcacccacaatcttcatgttgttgcagatgaaacgcgcgagatcgtctgacgagaccttcaaccccgtgtacccctacgataccgagatcgctccgacttctgtccctttccttacccctccctttgtgtcacccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagaggctcccctgcatgcaagtgacagcagtagcctgggccttagcgtcacggccccacttagcattaacaatgacagcctaggactagatctgcaggcacccattgtctctcaaaatggaaaactggctctaaatatagcaggccccctagctgtagccgatagcattaatgctttgacagtaggcactggcaaaggtattggactaaatgaaaccagcactcacttgcaagcaaaattggttgcccccctaggctttgataccaatggcaatattaagctaagcgttgcaggaggcatgaggctaaacaatgacacactgatactagatgtaaactacccatttgaagctcaaggtcaactaagcctaagagtgggcacaggtccactgtatgtagattctagcagtcataatctaaccattagatgccttaggggattgtatataacatcatctaacaaccaaaacggtctagaggccaacattaaactaacaaaaggccttgtgtatgaaggaaatgccatagcagttaatgttggtcaaggattgcaatacagcactactgccacatcggaaggtgtgtatcctatacagtctaagataggtttgggaatggaatatgataccaacggagccatgatggcaaaactaggctccggtctaagctttgataattcaggagccattgtggtgggaaacaaaaatgatgacaaacttaccctatggaccacacctgacccgtctcctaactgtagaatttattctgaaaaagatactaaactaaccttggtgctgactaagtgtggcagtcaaatcctaggcacagtatctgcccttgctgtcagaggcagccttgcgcccatcactaacgcatccagcatagtccaaatatttctacgatttgatgaaaatggactattgatgagcaactcatcgctagacggtgattactggaattacagaaatggggactccactaatggcacaccatatacaaatgcagtaggctttatgcctaatctagctgcctatcctaaaggtcaggctacaactgcaaaaagcagtattgtaagccaggtatacatggatggtgatactactaaacctataacactaaaaataaactttaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgtttttgatttcaaaattgtgtgcttttatttattttcaagcttacagtatttccagtagtcattcaaatagagcttaatgaaactgcatgagaacccttccacatagcttaaattatcaccagtgcaaatggagaaaaaatcaacatacctttttatccagatatcatagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcagtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgctgcaacaaggcgcgcagcaactcctgccgccgcctttccgtacgacaggaatgcaacggggtggtggtctcctccgcgataatccgcaccgctcgcaacatcagcgtcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcataccagatcctcaggtaaatcaaatgacgacctctcatgaacacgctggacatgtacatcacctccttaggcatgtgctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccttgcgtcttctgtctcgccgcctgccccgctcggtgtagtagttgtaatacagccactccctcagaccgtcaaggcgctccctggcgtccggatctataacaacaccatcctgcagcgccgccctgatgacatccaccaccgtagagtatgccaagcccagccaggaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaataaaaaagaaacattacacaagagtagcctgtcttacaatgggatagactactctaaccaacataagacgggccacaacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatatagcgcttccacagcagccatgacaaaagactcaaaacactcaaaagactcagtcttaccaggaaaataaaagcactctcacagcaccagcactaatcagagtgtgaaaaaggccaagtgccgaacgagtatatataggaattaaaaatgacgtaaatgtgtaaaggtcagaaaacgcccagaaaaatacacagaccaacgcccgaaacgaaaacccgcgaaaaaatacccagaagttcctcaacaaccgccacttccgctttcccacgagacgtcacttcctcaaaaatagcaaactacatttcccacatatacaaaaccaaaacccctccccttgtcaccgcccacaacttacatcatcacaaacgtcaaagcctacgtcacccgccccgcccacctcattatcatattggccacaatccaaaataaggtatattattgatgatg

SEQ ID NO: 7 - DNA, 37187 bp, Great Ape Adenovirus
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgaggacctggaagaagatgaagaagcgcaagcagaagagcaagcccctgttaaaaaaattcatgtatatgctcaggcgcctcttgctggcgaaaagattaccaaggatggtttgcaaataggtactgaagtcgtaggagatacatctaaggacacttttgcagataaaacattccaacccgaacctcagataggcgagtctcagtggaacgaggctgatgccacagcagcaggaggtagagttttgaaaaagactacccctatgagaccttgctatggatcctatgccaggcctaccaatgccaacgggggtcaaggaattatggttgccaatgaacaaggagtgttgcagtctaaagtagaaatgcaatttttctctaacacctcaacccttaatgcgcgggatggaaccggcaatcccgaaccaaaggtggtgttgtacagcgaagatgtccacttggaatctcccgatactcatctgtcttacaagcccaaaaaggatgatgttaatgccaaagtcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatggggttgaggatgaactgcccaactactgcttccctttgggcggcataggaattactgatacttatcaaggggtgaaaaatagcaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 8 - DNA, 37175 bp, Great Ape Adenovirus
catcatcaataatataccttattttggattgtggccaatatgataatgaggtgggcggggcgggtgacgtaggacgcgcgagtagggttgggaggtgtgcggaagtgtggcatttgcaagtgggaggagctcacatgtaagcttccgtcgcggaaaatgtgacgtttttaatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatctgacgcggagggtatttaaacccgctgcgctcctaaagaggccactcttgagtgccagcgagaagagttttctcctccgctccgtttcggcgatcgaaaaatgagacacttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggccgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcagggcaaggaaattaccttccattttgtgcaagcctaagacacctgtgaggaccagcgaggcggacagcactgactctggcacttctacctctcctcctgaaattcacccagtggttcctttgggtatacataaacctgttgctattagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtctccagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagtcggaggagcgagcggagaagatcagcttgagagccggcctggaccctcctcaggaggaatgaatctcccgcaggtggttgacctgtttcccgaactgagacgggtcctgactatcagggaagatggtcagtttgtgaagaagctgaagagggatcggggtgagggagatgatgaggcggctagcaatttagcttttagtctgataacccgccaccgaccggaatgtattacctatcagcagattaaggagagttgtgccaacgagctggatcttttgggtcagaagtatagcatagaacagcttaccacttactggcttcagcccggggatgattgggaagaggcgatcagggtgtatgcaaaggtggccctgcggcccgattgcaagtataagattactaagttggttaatattagaaactgctgctatatttctgggaacggggccgaagtggagatagatactgaggacagggtggctattaggtgttgcatgataaacatgtggcccgggatactggggatggatggggtgatatttatgaatgtaaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaacttcagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagcccctatctgacagtgcgcatgcctcactgggccggagtgcgtcagaatgtgatgggttccaacgtggatggacgtcccgttctgccttcaaattcgtctacgatggcctacgcgaccgtgggaggaactccgttggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagctgggaggggtgcatccggggggatatgatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttttccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagagtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggctgcccccatgctttttgatgcgtttcttacctcggctctccatgaggcggtgtcccttctcggtgacgaagaggctgtccgtgtccccgtagaccgatttcaggggcctgtcttccagcggagtgcctctgtcctcctcgtagagaaactctgaccactctgagacaaaggcccgtgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggtgccctttcatcttcactctcttccgcatcgctgtctgcgagagccagctgctggggtaagtattccctttcgaaggcgggcatgacctcagcgctcaggttgtcagtttctaaaaatgaggaagatttgatgttcacctgtccggaggtgatacctttgagggtacctgggtctatctggtcagaaaacactatttttttgttatcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagccgcggttgtgcagggtgaccatgtcgacgctggtggcgacctcaccgcgcaggcgctcgttggtccagcagaggcggccgcccttgcgcgagcagaaggggggtagggggtccagctggtcctcgttcggggggtccgcgtcgatggtaaagaccccggggagcagacgcgggtcaaagtagtcgatcttgcaagcttgcatgtccagagcccgctgccattcgcgggcggcgagcgcgcgctcgtaggggttgaggggcgggccccagggcatggggtgggtgagcgcagaggcgtacatgccgcagatgtcatacacgtacaggggttccctgaggatgccgaggtaggtggggtagcagcgccccccgcggatgctggcgcgcacgtagtcatagagttcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcacggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaggaagcggggctggcccttgatggaggggagctttttaagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcaatagaaggtgagggggtctttctcccaggggtcccatctgagctctcgggcgaggtcgcgtgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggtttacctcgcagagacgggtcaacgcacgggcagtgttaagatggtatctgatttcaaggggcgtgttggcggcggagtcgatggcttgcaggaggccgcagccccggggggccacgatggttccccgtggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacaaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctttcatctcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcctctccccgccccggtcaccacggccgcggcggccgtgtccggcgcggggggtgcgctggagtcagatgagccaccgcggcggcgacctaggcagtatctggacttggaagagggcgagggactggcgcggctgggggcgagctccccagagcgtcacccgcgggtgcagttgaaaagggacgcgcgcgaggcgtacctgccgcggcaaaacctgtttcgcgaccgcgggggcgaggagcccgaggagatgcgagactgcaggttccaagcagggcgcgagctgcgccgcggcttggacagagagcgcttgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgatgccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgcccgcaagatctacaagaccccctacgtgcccatagacaaggaggtgaagatagacagcttctacatgcgcatggcgctaaaggtgctgaccctgagcgacgacctgggagtgtaccgcaacgagcgcatccacaaggccgtgagcgccagccggcggcgcgagctgagcgaccgcgagctgatgcacagtctgcaacgcgcgctgaccggcgcgggcgagggcgacagggaggtcgagtcctacttcgacatgggggccgacctgcactggcagccgagccgccgcgccctggaggcggcgggggcgtatggcggccccctggcggccgatggcgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcggacgaggccggactggtgtacgatgcgctgctgcagcgggtggcgcggtacaacagcggcaacgtgcaaaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaacttcttgagcgcgctgcggctgatggtgaccgaggtccctcagagcgaagtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggactttgaggtgcccgaggtcaacgacgggttcctctgggatgacatggatgacagtgtgttctcccccaacccgctgcgcgccgcgtctctgcgattgaaggagggctctgacagggaaggaccgaggagtttggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctacagcccgtgagggacaaaaacgctcagcggcagcagtttcccaacaacgggatagagagcctggtggacaagatgtccagatggaagacgtatgcgcaggagtacaaggagtgggaggaccgacagccgcggcccctgccgccccctagacagcgctggcagcggcgtgcgtccaaccgccgctggaggcaggggcccgaggacgatgatgactctgcagatgacagcagcgtgttggatctgggcgggagcgggaaccccttttcgcacctgcgcccacgcctgggcaagatgttttaaaagagaaaaataaaaactcaccaaggccatggcgacgagcgttggtttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactattcagagaccatgactctcgacctgatgaacaatgcgatcgtggaacactatctgaaagtgggcaggcagaacggggtgaaggagagcgatatcggggtcaagtttgacaccagaaactttcgtctgggctgggaccccgtgaccgggctggtcatgccgggggtctacaccaacgaggcctttcatcccgatatagtgctcctgcccggctgtggggtggactttacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggtggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcgactgaagcagttaaggaaaaggcccaggcagagcaggaagagaaaaaacctgtcattcaacctctaaaagaagatagcaaaaagcgcagttacaacgtcatcgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtgcactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctaccctcacgctccaaaatcatgtccgtactcatctcgcccagcaacaacaccggctgggggctgcgcgcgcccagcaagatgtttggaggggcgaggaaacgctccgaacagcacccagtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtaagcggcacacgggtgcccgtgcgctttcgccccccacggaattagcacaaaacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgacgttgacgaggcggtggagtttgtccgccgcatggcgcccaggcgccccgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgctttggggagtttgcatatgggaaacggccccgcgagagcctaaaagaggacctgctggcgctaccgctggacgagggcaatcccaccccgagtctgaagccggtaaccctgcaacaggtgctgcctttgagcgcgcccagcgagcagaagcgagggttgaagcgcgagggcggggacctggcacccaccgtgcagttgatggtgcccaagcggcagaagctggaggacgtgctggagaaaatgaaagtagagcccgggatccagcccgaaatcaaggtccgccccatcaagcaggtggcgcccggcgtgggagtccagaccgtggacgttaggattcccacggaggagatggaaacccaaaccgccactccctcttcggcggctagcgccaccaccggcgccgcttcggtagaggtgcagacggacccctggctacctgccgccactgtcgccgccgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcacccgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcattgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaagagcaggcgcatgcgcggcggtgtgctgcccttcctaatcccgctaatcgccgcggcgatcggtgccgtgcccgggatcgcctccgtggccctgcaggcgtcccagaaacattgactcttgcaaccttgcaagcttgcattttttggaggaaaaaataaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagtggccttaaaaattttggttccaccattaagaactatggcaacaaagcgtggaacagcagcacgggccagatgctgagagacaagttgaaagagcagaacttccaggaaaaggtggcgcagggcctggcctctggcatcagcggggtggtggacatagctaaccaggccgtgcagaaaaagataaacagtcatctggacccccggcctcaggtggaggaaacgcctccagcaatggagacggtgtctcccgagggcaaaggcgaaaagcgcccgcggcccgacagggaagagaccctggtgtcacacaccgaggagccgccctcttacgaggaggcagtcaaggccggcctgcctaccactcgccccatagcccccatggccaccggtgtggtgggacacaggcaacacacccccgcaacactagatctgcccccgccgtccgatccgcctcgccagccaaaggcggcgacggtgtccgctccctccacttccgccgccaacagagtgcccctgcgccgcgctgcaagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggtttatccccgtggatcgggaggacaccgcctactcttacaaggcgcggtttacgctggccgtgggcgacaatcgcgtgctggacatggcctccacttactttgacatccggggggtgctggacaggggccccacttttaagccctactcgggcactgcctacaaccccctggcccccaagggcgcccccaattcttgtgagtgggaacaagaggaaactcaggcggccgaggaagctgttgacgaggaagatgcagaagatgaagcgcaaccacaagaggaagcccctgttaaaaaaattcatgtatatgctcaggcgcctcttgctggcgaaaagattaccaaggatggtttgcaaataggtactgaagtcgtaggagatacatctaaggacacttttgcagataaaacattccaacccgaacctcagataggcgagtctcagtggaacgaggctgatgccgcagtagcaggaggtagagttttgaaaaagactacccctatgagaccttgctatggatcctatgccaggcctaccaatgccaacgggggtcaaggaattatggttgccaatgaaaaaggagtgttgcagtctaaagtagaaatgcaatttttctctaacacctcaacccttaatgcgcgggatggaaccggcaatcccgaaccaaaggtggtgttgtacagcgaagatgtccacttggaatctcccgatactcatctgtcttacaagcccacaaaggatgatgttaatgccaaagtcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatggggttgaggatgaactgcccaactactgcttccctttgggcggcataggaattactgatacttatcaaggggtgaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgactttcgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgcctgcatgactggttccaccgagcaagagctcagggccatcgccagagacctgggatgcggaccctactttttgggcacctatgacaaacgcttcccgggtttcatctcccgagacaagctcgcctgcgccatcgtcaacacggccgcgcgcgagaccgggggcgtgcactggctggcctttggctgggacccgcgctctaaaacttgctacctctttgacccctttggcttctctgatcagcgcctcaggcagatttatgagtttgagtacgaggggctgctgcgccgcagcgcgcttgcctcctcgcccgaccgctgcatcacccttgagaagtccaccgagaccgtgcaggggccccactcggccgcctgcggtctcttctgttgcatgtttttgcacgcctttgtacactggcctcagagtcccatggatcgcaaccccaccatgaacttgctaaagggagtgcccaacgccatgctccagagcccccaggtcctgcccaccctgcgccgcaaccaggaacagctctaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaaattctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactgattcgcgggacagctggcatcgtgcaggcagcagcgcgcgtcagtgttggcgatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatagtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggcaccagggcctcgtcgccctcggactcttcctctgactccaggcggcggcggagtcgcttctttgggggcgcgcgcgtcagcggcggcggagacggggacggggacggggacgggacgccctccacagggggcggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctctgagaccgccgtcgccgtcgcccccgctaccgccgacgcgcccgccacaccgagcgacacccccgcggacccccccgccgacgcacccctgttcgaggaagcggccgtggagcaggacccgggctttgtctcggcagaggaggatttgcaagaggaggaggataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtaccaaagatcttcgagggtctgggtcgcaacgaaaagcgggcagcaaactctctgcaacaggaaaacagcgaaaatgagagtcacaccggggtgctggtggagctcgagggcgacaacgcccgcctggcggtgctcaagcgcagcatcgaggtcacccactttgcctaccccgcgctcaacctgccccccaaagtcatgaacgcggtcatggacgggctgatcatgcgccgcggccagccccttgctccagatgcaaacttgcatgaggagaccgaggacggccagcccgtggtcagcgacgagcagctggcgcgctggctggaaaccgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgagaaccgccttgggcagagcgtgctgcactccaccctgcgcggggaagcgcgccgcgactacgtgcgcgactgcgtttaccttttcctctgctacacctggcagacggccatgggggtctggcagcagtgcctggaggagcgcaacctcaaggagctggagaagctcctgcagcgcgcgctcaaagacctctggacgggcttcaacgagcgctcggtggccgccgcgctggccgacctcatcttccccgagcgcctgctcaaaactctccagcaggggctgcccgacttcaccagccaaagcatgttgcaaaactttaggaactttatcctggagcgttctggcatcctacccgccacctgctgcgccctgcccagtgactttgttcccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagagtttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggagtactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggaaaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccggcggcagcggcgcccgtttcggtgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcacacggggtgcgctttttcatcccgagtcaggtccgctctaccctaatcagggagtttacagcccgtcccctactggcggagttggaaaaggggccttctatcctaaccattgcctgcatctgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggtccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgagaccctacccaacgaatcgggattgaatatcggtaaccaggttgcagtttcacttttgattacctttatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactatcctaatcaaatgtgttactcaacacgataaggtaactgttaaatacaaagatcaattaaaaaaagacgcactttacagcagctggcaaccaggagatgaacaaaaatacaatgtaaccgtcttccagggcaaactctccaaaacttacaattacactttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatatcagatttaaatcaaggcaaagctttattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatgattaattactggagaccccacagagattacatgcttcacgtagtaaagggtcccattagcagcccaaccaccacctctaccacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagagtcagaagcgctgccggtggccctaaaacagtatgcagacccccacaccacccccgaccttcctccaccttcccagaagccaagtttcctgggggaaaatgaaactctgcctctctccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagcctctgtccaattttttcagcaacacttccttcccctcttcccaactctggtactctaggcgcctcctagctgcaaacttcctccacagtctgaagggaatgtcagattcctcctcctcctgtccctccgcacccacaatcttcatgttgttgcagatgaaacgcgcgagatcgtctgacgagaccttcaaccccgtgtacccctacgataccgagatcgctccgacttctgtccctttccttacccctccctttgtgtcacccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagaggctcccctgcatgcaagtgacagcagtagcctgggccttagcgtcacggccccacttagcattaacaatgacagcctaggactagatctgcaggcacccattgtctctcaaaatggaaaactggctctaaatatagcaggccccctagctgtagccgatagcattaatgctttgacagtaggcactggcaaaggtattggactaaatgaaaccagcactcacttgcaagcaaaattggttgcccccctaggctttgataccaatggcaatattaagctaagcgttgcaggaggcatgaggctaaacaatgacacactgatactagatgtaaactacccatttgaagctcaaggtcaactaagcctaagagtgggcacaggtccactgtatgtagattctagcagtcataatctaaccattagatgccttaggggattgtatataacatcatctaacaaccaaaacggtctagaggccaacattaaactaacaaaaggccttgtgtatgaaggaaatgccatagcagttaatgttggtcaaggattgcaatacagcactactgccacatcggaaggtgtgtatcctatacagtctaagataggtttgggaatggaatatgataccaacggagccatgatggcaaaactaggctccggtctaagctttgataattcaggagccattgtggtgggaaacaaaaatgatgacaaacttaccctatggaccacacctgacccgtctcctaactgtagaatttattctgaaaaagatactaaactaaccttggtgctgactaagtgtggcagtcaaatcctaggcacagtatctgcccttgctgtcagaggcagccttgcgcccatcactaacgcatccagcatagtccaaatatttctacgatttgatgaaaatggactattgatgagcaactcatcgctagacggtgattactggaattacagaaatggggactccactaatggcacaccatatacaaatgcagtaggctttatgcctaatctagctgcctatcctaaaggtcaggctacaactgcaaaaagcagtattgtaagccaggtatacatggatggtgatactactaaacctataacactaaaaataaactttaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgtttttgatttcaaaattgtgtgcttttatttattttcaagcttacagtatttccagtagtcattcaaatagagcttaatgaaactgcatgagaacccttccacatagcttaaattatcaccagtgcaaatggagaaaaaatcaacatacctttttatccagatatcatagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcagtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgctgcaacaaggcgcgcagcaactcctgccgccgcctttccgtacgacaggaatgcaacggggtggtggtctcctccgcgataatccgcaccgctcgcaacatcagcgtcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcataccagatcctcaggtaaatcaaatgacgacctctcatgaacacgctggacatgtacatcacctccttaggcatgtgctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccttgcgtcttctgtctcgccgcctgccccgctcggtgtagtagttgtaatacagccactccctcagaccgtcaaggcgctccctggcgtccggatctataacaacaccatcctgcagcgccgccctgatgacatccaccaccgtagagtatgccaagcccagccaggaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaataaaaaagaaacattacacaagagtagcctgtcttacaatgggatagactactctaaccaacataagacgggccacaacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatatagcgcttccacagcagccatgacaaaagactcaaaacactcaaaagactcagtcttaccaggaaaataaaagcactctcacagcaccagcactaatcagagtgtgaaaaaggccaagtgccgaacgagtatatataggaattaaaaatgacgtaaatgtgtaaaggtcagaaaacgcccagaaaaatacacagaccaacgcccgaaacgaaaacccgcgaaaaaatacccagaagttcctcaacaaccgccacttccgctttcccacgagacgtcacttcctcaaaaatagcaaactacatttcccacatatacaaaaccaaaacccctccccttgtcaccgcccacaacttacatcatcacaaacgtcaaagcctacgtcacccgccccgcccacctcattatcatattggccacaatccaaaataaggtatattattgatgatg

SEQ ID NO: 9 - DNA, 37190 bp, Great Ape Adenovirus
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaactcaggcggccgaggaagctgttgacgaggaagatgcagaagatgaagcgcaaccacaagaggaagcccctgttaaaaaaattcatgtatatgctcaggcgcctcttgctggcgaaaagattaccaaggatggtttgcaaataggtactgaagtcgtaggagatacatctaaggacacttttgcagataaaacattccaacccgaacctcagataggcgagtctcagtggaacgaggctgatgccgcagtagcaggaggtagagttttgaaaaagactacccctatgagaccttgctatggatcctatgccaggcctaccaatgccaacgggggtcaaggaattatggttgccaatgaaaaaggagtgttgcagtctaaagtagaaatgcaatttttctctaacacctcaacccttaatgcgcgggatggaaccggcaatcccgaaccaaaggtggtgttgtacagcgaagatgtccacttggaatctcccgatactcatctgtcttacaagcccacaaaggatgatgttaatgccaaagtcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatggggttgaggatgaactgcccaactactgcttccctttgggcggcataggaattactgatacttatcaaggggtgaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 10 - DNA, 37184 bp, Great Ape Adenovirus
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgatgaacttgaagatgaagaagcgcaagcacaagaggaagcccctgtgaaaaaaattcatgtatatgctcaggcgcctctttctggcgaaaagattaccaaggatggtttgcaaataggtactgaagtcgtaggagatacatctaaggacacttttgcagataaaacattccaacccgaacctcagataggcgagtctcagtggaacgaggctgatgccacagtagcaggaggtagagttttgaaaaagactacccctatgagaccttgctatggatcctatgccaggcctaccaatgccaacgggggtcaaggaattatggttgccaatgaacaaggagtgttggagtctaaagtagaaatgcaatttttctctaacaccacaacccttaatgcgcgggatggaaccggcaatcccgaaccaaaggtggtgttgtacagcgaagatgtccacttggaatctcccgatactcatctgtcttacaagcccaaaaaggatgatgttaatgccaaaatcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatgggactgaggatgaactgcccaactactgcttccctttgggcggcataggagttactgatacttatcaagggataaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 11 - protein, 29 aa, Great Ape Adenovirus
EQEENQVVAADDELEDEEAQAQEEAPVKK

SEQ ID NO: 12 - protein, 15 aa, Great Ape Adenovirus
IQIGTEVVGDTSKDT

SEQ ID NO: 13 - protein, 7 aa, Great Ape Adenovirus
NEADATA

SEQ ID NO: 14 - protein, 12 aa, Great Ape Adenovirus
MVANEQGVLESK

SEQ ID NO: 15 - protein, 15 aa, Great Ape Adenovirus
NTTTLNARDGTGNPE

SEQ ID NO: 16 - protein, 9 aa, Great Ape Adenovirus
KKDDVNAKI

SEQ ID NO: 17 - protein, 26 aa, Great Ape Adenovirus
VTDTYQGIKNTNGNGQWTKDDQFADR

SEQ ID NO: 18 - protein, 29 aa, Great Ape Adenovirus
EQEENQVEAADEDVEDEEAQAQEEAPAKK

SEQ ID NO: 19 - protein, 15 aa, Great Ape Adenovirus
LQIGTEVVGETSKDT

SEQ ID NO: 20 - protein, 7 aa, Great Ape Adenovirus
NEADAAV

SEQ ID NO: 21 - protein, 12 aa, Great Ape Adenovirus
LVANEQGVMESK

SEQ ID NO: 22 - protein, 15 aa, Great Ape Adenovirus
NTSTLNARDGTGNPE

SEQ ID NO: 23 - protein, 9 aa, Great Ape Adenovirus
KKDDVNAKV

SEQ ID NO: 24 - protein, 26 aa, Great Ape Adenovirus
ITDTYQGVKNTNGNGQWTKDDQFADR

SEQ ID NO: 25 - protein, 30 aa, Great Ape Adenovirus
EQEENQVVAADEDLEEDEEAQAEEQAPAKK

SEQ ID NO: 26 - protein, 15 aa, Great Ape Adenovirus
LQIGTEVVGDTSKDT

SEQ ID NO: 27 - protein, 7 aa, Great Ape Adenovirus
NEADATA

SEQ ID NO: 28 - protein, 12 aa, Great Ape Adenovirus
MVANEQGVLQSK

SEQ ID NO: 29 - protein, 15 aa, Great Ape Adenovirus
NTSTLNARDGTGNPE

SEQ ID NO: 30 - protein, 9 aa, Great Ape Adenovirus
KKDDVNAKV

SEQ ID NO: 31 - protein, 26 aa, Great Ape Adenovirus
ITDTYQGVKNSNGNGQWTKDDQFADR

SEQ ID NO: 32 - protein, 31 aa, Great Ape Adenovirus
EQEETQAAEEAVDEEDAEDEAQPQEEAPAKK

SEQ ID NO: 33 - protein, 15 aa, Great Ape Adenovirus
LQIGTEVVGDTSKDT

SEQ ID NO: 34 - protein, 7 aa, Great Ape Adenovirus
NEADAAV

SEQ ID NO: 35 - protein, 12 aa, Great Ape Adenovirus
MVANEKGVLQSK

SEQ ID NO: 36 - protein, 15 aa, Great Ape Adenovirus
NTSTLNARDGTGNPE

SEQ ID NO: 37 - protein, 9 aa, Great Ape Adenovirus
TKDDVNAKV

SEQ ID NO: 38 - protein, 26 aa, Great Ape Adenovirus
ITDTYQGVKNTNGNGQWTKDDQFADR

SEQ ID NO: 39 - protein, 29 aa, Great Ape Adenovirus
EQEENQVVAADDELEDEEAQAQEEAPVKK

SEQ ID NO: 40 - protein, 15 aa, Great Ape Adenovirus
LQIGTEVVGDTSKDT

SEQ ID NO: 41 - protein, 7 aa, Great Ape Adenovirus
NEADATV

SEQ ID NO: 42 - protein, 12 aa, Great Ape Adenovirus
MVANEQGVLESK

SEQ ID NO: 43 - protein, 15 aa, Great Ape Adenovirus
NTTTLNARDGTGNPE

SEQ ID NO: 44 - protein, 9 aa, Great Ape Adenovirus
KKDDVNAKI

SEQ ID NO: 45 - protein, 26 aa, Great Ape Adenovirus
VTDTYQGIKNTNGNGQWTKDDQFADR

SEQ ID NO: 46 - protein, 955 aa, Great Ape Adenovirus
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNPLAPKGAPNSCEWEQEENQVVAADDELEDEEAQAQEEAPVKKIHVYAQAPLSGEKISKDGIQIGTEVVGDTSKDTFADKTFQPEPQIGESQWNEADATAAGGRVLKKTTPMRPCYGSYARPTNANGGQGIMVANEQGVLESKVEMQFFSNTTTLNARDGTGNPEPKVVLYSEDVHLESPDTHLSYKPKKDDVNAKIMLGQQAMPNRPNLIGFRDNFIGLMFYNSTGNMGVLAGQASQLNAVVDLQDRNTELSYQLLLDSIGDRTRYFSMWNQAVDSYDPDVRIIENHGTEDELPNYCFPLGGIGVTDTYQGIKNTNGNGQWTKDDQFADRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSITLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETNYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 47 - protein, 955 aa, Great Ape Adenovirus
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNPLAPKGAPNSCEWEQEENQVEAADEDVEDEEAQAQEEAPVKKIHVYAQAPLAGEKITKDGLQIGTEVVGETSKDTFADKTFQPEPQIGESQWNEADAAVAGGRVLKKTTPMRPCYGSYARPTNANGGQGILVANEQGVMESKVEMQFFSNTSTLNARDGTGNPEPKVVLYSEDVHLESPDTHLSYKPKKDDVNAKVMLGQQAMPNRPNLIGFRDNFIGLMFYNSTGNMGVLAGQASQLNAVVDLQDRNTELSYQLMLDSIGDRTRYFSMWNQAVDSYDPDVRIIENHGVEDELPNYCFPLGGIGITDTYQGVKNTNGNGQWTKDDQFADRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSITLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETNYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 48 - protein, 956 aa, Great Ape Adenovirus
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNPLAPKGAPNSCEWEQEENQVVAADEDLEEDEEAQAEEQAPVKKIHVYAQAPLAGEKITKDGLQIGTEVVGDTSKDTFADKTFQPEPQIGESQWNEADATAAGGRVLKKTTPMRPCYGSYARPTNANGGQGIMVANEQGVLQSKVEMQFFSNTSTLNARDGTGNPEPKVVLYSEDVHLESPDTHLSYKPKKDDVNAKVMLGQQAMPNRPNLIGFRDNFIGLMFYNSTGNMGVLAGQASQLNAVVDLQDRNTELSYQLMLDSIGDRTRYFSMWNQAVDSYDPDVRIIENHGVEDELPNYCFPLGGIGITDTYQGVKNSNGNGQWTKDDQFADRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSITLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETNYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 49 - protein, 957 aa, Great Ape Adenovirus
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNPLAPKGAPNSCEWEQEETQAAEEAVDEEDAEDEAQPQEEAPVKKIHVYAQAPLAGEKITKDGLQIGTEVVGDTSKDTFADKTFQPEPQIGESQWNEADAAVAGGRVLKKTTPMRPCYGSYARPTNANGGQGIMVANEKGVLQSKVEMQFFSNTSTLNARDGTGNPEPKVVLYSEDVHLESPDTHLSYKPTKDDVNAKVMLGQQAMPNRPNLIGFRDNFIGLMFYNSTGNMGVLAGQASQLNAVVDLQDRNTELSYQLMLDSIGDRTRYFSMWNQAVDSYDPDVRIIENHGVEDELPNYCFPLGGIGITDTYQGVKNTNGNGQWTKDDQFADRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSITLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETNYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 50 - protein, 955 aa, Great Ape Adenovirus
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNPLAPKGAPNSCEWEQEENQVVAADDELEDEEAQAQEEAPVKKIHVYAQAPLSGEKITKDGLQIGTEVVGDTSKDTFADKTFQPEPQIGESQWNEADATVAGGRVLKKTTPMRPCYGSYARPTNANGGQGIMVANEQGVLESKVEMQFFSNTTTLNARDGTGNPEPKVVLYSEDVHLESPDTHLSYKPKKDDVNAKIMLGQQAMPNRPNLIGFRDNFIGLMFYNSTGNMGVLAGQASQLNAVVDLQDRNTELSYQLMLDSIGDRTRYFSMWNQAVDSYDPDVRIIENHGTEDELPNYCFPLGGIGVTDTYQGIKNTNGNGQWTKDDQFADRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSITLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETNYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 51 - protein, 651 aa, Great Ape Adenovirus
MRRAAMFEEGPPPSYESAMGISPAAPLQPPYVPPRYLQPTGGRNSICYSELQPLYDTTRLYLVDNKSADVASLNYQNDHSDFLTTVIQNNDFTPTEASTQTINLDNRSNWGGDLKTILHTNMPNVNEFMFTNSFKARVMVAREQGEAKYEWVDFTLPEGNYSETMTLDLMNNAIVEHYLKVGRQNGVKESDIGVKFDTRNFRLGWDPVTGLVMPGVYTNEAFHPDIVLLPGCGVDFTQSRLSNLLGVRKRQPFQEGFKITYEDLEGGNIPALLDLDAYEESLKPEESAGDSGESGEEQAGGGGSASVENESTPAVAADAAEVEPEAMQQDAEEGAQEDMNNGEIRGDTFATRGEEKEAEAAAATAEAETEAEAEPETEVMEDMNDGERRGDTFATRGEEKAAEAEAAAEEAAAAAAKAEAAAEAKVEADVAVEAQAEEEAAAEAVKEKAQAEQEEKKPVIQPLKEDSKKRSYNVIEGSTFTQYRSWYLAYNYGDPVKGVRSWTLLCTPDVTCGSEQMYWSLPNMMQDPVTFRSTRQVSNFPVVGAELLPVHSKSFYNEQAVYSQLIRQATSLTHVFNRFPENQILARPPAPTITTVSENVPALTDHGTLPLRNSISGVQRVTITDARRRTCPYVYKALGIVSPRVLSSRTF

SEQ ID NO: 52 - protein, 651 aa, Great Ape Adenovirus
MRRAAMFEEGPPPSYESAMGISPAAPLQPPYVPPRYLQPTGGRNSICYSELQPLYDTTRLYLVDNKSADVASLNYQNDHSDFLTTVIQNNDFTPTEASTQTINLDNRSNWGGDLKTILHTNMPNVNEFMFTNSFKARVMVAREQGEAKYEWVDFTLPEGNYSETMTLDLMNNAIVEHYLKVGRQNGVKESDIGVKFDTRNFRLGWDPVTGLVMPGVYTNEAFHPDIVLLPGCGVDFTQSRLSNLLGVRKRQPFQEGFKITYEDLEGGNIPALLDLDAYEESLKPEESAGDSGESGEEQAGGGGSASVENESTPAVAADAAEVEPEAMQQDAEEGAQEDMNNGEIRGDTFATRGEEKEAEAAAATAEAETEAEAEPETEVMEDMNDGERRGDTFATRGEEKAAEAEAAAEEAAAAAAKAEAAAEAKVEADVAVEAQAEEEAATEAVKEKAQAEQEEKKPVIQPLKEDSKKRSYNVIEGSTFTQYRSWYLAYNYGDPVKGVRSWTLLCTPDVTCGSEQMYWSLPNMMQDPVTFRSTRQVSNFPVVGAELLPVHSKSFYNEQAVYSQLIRQATSLTHVFNRFPENQILARPPAPTITTVSENVPALTDHGTLPLRNSISGVQRVTITDARRRTCPYVYKALGIVSPRVLSSRTF

SEQ ID NO: 53 - protein, 598 aa, Great Ape Adenovirus
MSDSSSCPSAPTIFMLLQMKRARSSDETFNPVYPYDTEIAPTSVPFLTPPFVSSAGMQENPAGVLSLHLSEPLTTHNGALTLKMGGGLTLDKEGNLTSQNITSVDPPLKKSKNNISLQTAAPLAVSSGALTLFATPPLAVSGDNLTVQSQAPLTLEDSKLTLATKGPLTVSEGKLVLETEPPLHASDSSSLGLSVTAPLSINNDSLGLDMQAPISSRDGKLALTVAAPLTVAEGINALAVATGNGIGLNETNTHLQAKLVAPLGFDTNGNIKLSVAGGMRLNNNTLILDVNYPFEAQGQLSLRVGSGPLYVDSSSHNLTIRCLRGLYVTSSNNQNGLEANIKLTKGLVYDGNAIAVNVGKGLEYSPTGTTEKPIQTKIGLGMEYDTEGAMMTKLGSGLSFDNSGAIVVGNKNDDRLTLWTTPDPSPNCQIYSEKDAKLTLVLTKCGSQVVGTVSIAALKGSLVPITSAISVVQIYLRFDENGVLMSNSSLNGEYWNFRNGDSTNGTPYTNAVGFMPNLLAYPKGQTTTAKSNIVSQVYMNGDDTKPMTFTINFNGLSETGDTPVSKYSMTFSWRWPNGSYIGHNFVTNSFTFSYIAQE

SEQ ID NO: 54 - protein, 602 aa, Great Ape Adenovirus
MSDSSSSCPSAPTIFMLLQMKRARSSDETFNPVYPYDTEIAPTSVPFLTPPFVSPAGMQENPAGVLSLHLSEPLTTHNGALTLKMGGGLILDKEGNLTSQNITSVDPPLKKSKNNISLQTAAPLAVSSGALTLFATPPLAVSGDNLTVQSQAPLTLEDSKLTLATKGPLTVSEGKLVLETEAPLHASDSSSLGLSVTAPLSINNDSLGLDLQAPIVSQNGKLALNIAGPLAVADSINALTVGTGKGIGLNETSTHLQAKLVAPLGFDTNGNIKLSVAGGMRLNNDTLILDVNYPFEAQGQLSLRVGTGPLYVDSSSHNLTIRCLRGLYITSSNNQNGLEANIKLTKGLVYEGNAIAVNVGQGLQYSTTATSEGVYPIQSKIGLGMEYDTNGAMMAKLGSGLSFDNSGAIVVGNKNDDKLTLWTTPDPSPNCRIYSEKDTKLTLVLTKCGSQILGTVSALAVRGSLAPITNASSIVQIFLRFDENGLLMSNSSLDGDYWNYRNGDSTNGTPYTNAVGFMPNLAAYPKGQATTAKSSIVSQVYMDGDTTKPITLKINFNGIDETTENTPVSKYSMTFSWSWPTASYIGHTFATNSFTFSYIAQE

SEQ ID NO: 55 - DNA, 168 bp, Great Ape Adenovirus
agggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagccctttt

SEQ ID NO: 56 - DNA, 168 bp, Great Ape Adenovirus
agggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagccctttt

SEQ ID NO: 57 - DNA, 174 bp, Great Ape Adenovirus
ggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagcccctttt

SEQ ID NO: 58 - DNA, 104 bp, Artificial Sequence
  FW primer GAd-GAG left end
gaactccgaattcgtttaaaccatcatcaataatataccttattttggattgaggccaatatgataatgaggtgggcggggcgaggcggggcgggtgacgtagg

SEQ ID NO: 59 - DNA, 43 bp, Artificial Sequence
  RV primer GAd-GAG left end
cataatcggccgcagcggcccgtcagatgacggcgacaataaa

SEQ ID NO: 60 - DNA, 37 bp, Artificial Sequence
  FW primer GAd right end
cataatcgacccgagtcgcactctcacagcaccagca

SEQ ID NO: 61 - DNA, 47 bp, Artificial Sequence
  RV primer GAd right end
gaactccggatccgtttaaaccatcatcaataatataccttattttg

SEQ ID NO: 62 - DNA, 35 bp, Artificial Sequence
  FW primer pIX
cataatcgcgatcgcgcttaggcctgaccatctgg

SEQ ID NO: 63 - DNA, 34 bp, Artificial Sequence
  RV primer pIX
gaactccggcgcgccttagggggaggcaaggctg

SEQ ID NO: 64 - DNA, 55 bp, Artificial Sequence
  FW primer Amp-LacZ-SacB Ex. 2
gaactccggcgcgcctagggataacagggtaatacccctatttgtttatttttct

SEQ ID NO: 65 - DNA, 56 bp, Artificial Sequence
  RV primer Amp-LacZ-SacB Ex. 2
cataatcggcgcgccattaccctgttatccctattatttgttaactgttaattgtc

SEQ ID NO: 66 - DNA, 92 bp, Artificial Sequence
  FW primer Amp-LacZ-SacB Ex. 4
ggattacaccaagatctttgctgtcatttgtgtgctgagtataataaaggctgagatcagaatctactcgacccctatttgtttatttttct

SEQ ID NO: 67 - DNA, 93 bp, Artificial Sequence
  RV primer Amp-LacZ-SacB Ex. 4
cttgctatcagatttcaagtaagtgattttttattgattacagttatgatcaattgaaagggataaggtcttatttgttaactgttaattgtc

SEQ ID NO: 68 - DNA, 100 bp, Artificial Sequence
  SS oligo Amp-LacZ-SacB
ctgtcatttgtgtgctgagtataataaaggctgagatcagaatctactcggaccttatccctttcaattgatcataactgtaatcaataaaaaatcactt

SEQ ID NO: 69 - DNA, 29 bp, Artificial Sequence
  CMVfw
catctacgtattagtcatcgctattacca

SEQ ID NO: 70 - DNA, 21 bp, Artificial Sequence
  CMVrv
gacttggaaatccccgtgagt

SEQ ID NO: 71 - DNA, 25 bp, Artificial Sequence
  CMVFAM-TAMRA probe
acatcaatgggcgtggatagcggtt

SEQ ID NO: 72 - DNA, 33360 bp, Artificial Sequence
  GADNOU19 GAG (DE1DE3)
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgggccgccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtgagatctaccatgggtgctagggcttctgtgctgtctggtggtgagctggacaagtgggagaagatcaggctgaggcctggtggcaagaagaagtacaagctaaagcacattgtgtgggcctccagggagctggagaggtttgctgtgaaccctggcctgctggagacctctgaggggtgcaggcagatcctgggccagctccagccctccctgcaaacaggctctgaggagctgaggtccctgtacaacacagtggctaccctgtactgtgtgcaccagaagattgatgtgaaggacaccaaggaggccctggagaagattgaggaggagcagaacaagtccaagaagaaggcccagcaggctgctgctggcacaggcaactccagccaggtgtcccagaactaccccattgtgcagaacctccagggccagatggtgcaccaggccatctccccccggaccctgaatgcctgggtgaaggtggtggaggagaaggccttctcccctgaggtgatccccatgttctctgccctgtctgagggtgccaccccccaggacctgaacaccatgctgaacacagtggggggccatcaggctgccatgcagatgctgaaggagaccatcaatgaggaggctgctgagtgggacaggctgcatcctgtgcacgctggccccattgcccccggccagatgagggagcccaggggctctgacattgctggcaccacctccaccctccaggagcagattggctggatgaccaacaacccccccatccctgtgggggaaatctacaagaggtggatcatcctgggcctgaacaagattgtgaggatgtactcccccacctccatcctggacatcaggcagggccccaaggagcccttcagggactatgtggacaggttctacaagaccctgagggctgagcaggcctcccaggaggtgaagaactggatgacagagaccctgctggtgcagaatgccaaccctgactgcaagaccatcctgaaggccctgggccctgctgccaccctggaggagatgatgacagcctgccagggggtggggggccctggtcacaaggccagggtgctggctgaggccatgtcccaggtgaccaactccgccaccatcatgatgcagaggggcaacttcaggaaccagaggaagacagtgaagtgcttcaactgtggcaaggtgggccacattgccaagaactgtagggcccccaggaagaagggctgctggaagtgtggcaaggagggccaccagatgaaggactgcaatgagaggcaggccaacttcctgggcaaaatctggccctcccacaagggcaggcctggcaacttcctccagtccaggcctgagcccacagcccctcccgaggagtccttcaggtttggggaggagaagaccacccccagccagaagcaggagcccattgacaaggagctgtaccccctggcctccctgaggtccctgtttggcaacgacccctcctcccagtaaaataaagcccatcagaattcagtcgacagcggccgcgatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggccgggccgcgatcgcgcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgatgaacttgaagatgaagaagcgcaagcacaagaggaagcccctgtgaaaaaaattcatgtatatgctcaggcgcctctttctggcgaaaagattaccaaggatggtttgcaaataggtactgaagtcgtaggagatacatctaaggacacttttgcagataaaacattccaacccgaacctcagataggcgagtctcagtggaacgaggctgatgccacagtagcaggaggtagagttttgaaaaagactacccctatgagaccttgctatggatcctatgccaggcctaccaatgccaacgggggtcaaggaattatggttgccaatgaacaaggagtgttggagtctaaagtagaaatgcaatttttctctaacaccacaacccttaatgcgcgggatggaaccggcaatcccgaaccaaaggtggtgttgtacagcgaagatgtccacttggaatctcccgatactcatctgtcttacaagcccaaaaaggatgatgttaatgccaaaatcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttatgcttgattcaattggggatagaaccagatacttctccatgtggaaccaggcagtggatagctatgatccagatgtcagaattattgaaaaccatgggactgaggatgaactgcccaactactgcttccctttgggcggcataggagttactgatacttatcaagggataaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcggaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 73 - DNA, 33360 bp, Artificial Sequence
  GADNOU20 GAG (DE1DE3)
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgggccgccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtgagatctaccatgggtgctagggcttctgtgctgtctggtggtgagctggacaagtgggagaagatcaggctgaggcctggtggcaagaagaagtacaagctaaagcacattgtgtgggcctccagggagctggagaggtttgctgtgaaccctggcctgctggagacctctgaggggtgcaggcagatcctgggccagctccagccctccctgcaaacaggctctgaggagctgaggtccctgtacaacacagtggctaccctgtactgtgtgcaccagaagattgatgtgaaggacaccaaggaggccctggagaagattgaggaggagcagaacaagtccaagaagaaggcccagcaggctgctgctggcacaggcaactccagccaggtgtcccagaactaccccattgtgcagaacctccagggccagatggtgcaccaggccatctccccccggaccctgaatgcctgggtgaaggtggtggaggagaaggccttctcccctgaggtgatccccatgttctctgccctgtctgagggtgccaccccccaggacctgaacaccatgctgaacacagtggggggccatcaggctgccatgcagatgctgaaggagaccatcaatgaggaggctgctgagtgggacaggctgcatcctgtgcacgctggccccattgcccccggccagatgagggagcccaggggctctgacattgctggcaccacctccaccctccaggagcagattggctggatgaccaacaacccccccatccctgtgggggaaatctacaagaggtggatcatcctgggcctgaacaagattgtgaggatgtactcccccacctccatcctggacatcaggcagggccccaaggagcccttcagggactatgtggacaggttctacaagaccctgagggctgagcaggcctcccaggaggtgaagaactggatgacagagaccctgctggtgcagaatgccaaccctgactgcaagaccatcctgaaggccctgggccctgctgccaccctggaggagatgatgacagcctgccagggggtggggggccctggtcacaaggccagggtgctggctgaggccatgtcccaggtgaccaactccgccaccatcatgatgcagaggggcaacttcaggaaccagaggaagacagtgaagtgcttcaactgtggcaaggtgggccacattgccaagaactgtagggcccccaggaagaagggctgctggaagtgtggcaaggagggccaccagatgaaggactgcaatgagaggcaggccaacttcctgggcaaaatctggccctcccacaagggcaggcctggcaacttcctccagtccaggcctgagcccacagcccctcccgaggagtccttcaggtttggggaggagaagaccacccccagccagaagcaggagcccattgacaaggagctgtaccccctggcctccctgaggtccctgtttggcaacgacccctcctcccagtaaaataaagcccatcagaattcagtcgacagcggccgcgatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggccgggccgcgatcgcgcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgatgaacttgaagatgaagaagcgcaagcacaagaggaagcccctgtgaaaaaaattcatgtatatgctcaggcgcctctttctggcgaaaagatttccaaggatggtatccaaataggtactgaagtcgtaggagatacatctaaggacacttttgcagataaaacattccaacccgaacctcagataggcgagtctcagtggaacgaggctgatgccacagcagcaggaggtagagttttgaaaaagactacccctatgagaccttgctatggatcctatgccaggcctaccaatgccaacgggggtcaaggaattatggttgccaatgaacaaggagtgttggagtctaaagtagaaatgcaatttttctctaacaccacaacccttaatgcgcgggatggaaccggcaatcccgaaccaaaggtggtgttgtacagcgaagatgtccacttggaatctcccgatactcatctgtcttacaagcccaaaaaggatgatgttaatgccaaaatcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttctgcttgattcaattggggatagaaccagatacttctccatgtggaaccaggcagtggatagctatgatccagatgtcagaattattgaaaaccatgggactgaggatgaactgcccaactactgcttccctttgggcggcataggagttactgatacttatcaagggataaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcggaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttgtaggcacagtatctattgccgctcttaaaggtagccttgtgccaatcactagtgcaatcagtgtggttcagatatacctaaggtttgatgaaaatggggtgctgatgagtaactcttcacttaatggcgaatactggaattttagaaacggagactcaactaatggcacaccatatacaaacgcagtgggttttatgcctaatctactggcctatcctaaaggtcaaactacaactgcaaaaagtaacattgtcagccaggtctacatgaacggggacgatactaaacccatgacatttacaatcaacttcaatggccttagtgaaacaggggatacccctgtcagtaaatattccatgacattctcatggaggtggccaaatggaagctacatagggcacaattttgtaacaaactcctttactttctcctacatcgcccaagaataaagaaagcacagagatgcttgtttttgatttcaaaattgtgtgcttttatttattttcaagcttacagtatttccagtagtcattagaatagagcttaattaaactgcatgagaacccttccacatagcttaaattatcaccagtgcaaatggaaaaaaatcaacatacctttttatccagatatcaaagaactctagtggtcagttttcccccaccctcccagctcacagaatacacagtcctttccccccggctggctttaaacaacactatctcattggtaacagacatatttttaggtgtaataatccacacggtctcttggcgggccaaacgctggtctgtgatgttaataaactccccaggcagctctttcaagttcacgtcgctgtccaactgctgaagcgctcgcggctccgactgcgcctctagcggaggcaacggcagcacccgatccttgatctataaaggagtagagtcataatcccccataagaatagggcggtgatgcagcaacaaggcgcgcagcaactcctgccgccgcctctccgtacgacaggaatgcaacggggtggtggtctcctccgcgataatccgcaccgctcgcagcatcagcatcctcgtcctccgggcacagcagcgcatcctgatctcactgagatcggcgcagtaagtgcagcacaacaccaagatgttatttaagatcccacagtgcaaagcactgtacccaaagctcatggcgggaaggacagcccccacgtgaccatcgtaccagatcctcaggtaaatcaaatgacgacctctcataaacacgctggacatatacatcacctccttgggcatgagctgattcaccacctctcgataccacaggcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaagaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccacgaaatgcactcactttgacagcgagagataggaggagcgggaagagatggaagaaccatgatagtaaaagaacttttattccaatcgatcctctacaatgtcaaagtgtagatctatcagatggcactggtctcctccgctgagtcgatcaaaaataacagctaaaccacaaacaacacgattggtcaaatgctgcacaagggcttgcagcataaaatcgcctcgaaagtccaccgcaagcataacatcaaagccaccgcccctatcatgatctatgataaaaaccccacagctatccaccagacccatatagttttcatctctccatcgtgaaaaaatatttacaagctcctcctttaaatcacctccaaccaattcaaaaagttgagccagaccgccctccaccttcattttcagcatgcgcatcatgattgcaaaaattcaggctcctcagacacctgtataagattgagaagcggaacgttaacatcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacaatgggatagactactctaaccaacataagacgggccacgacatcgcccgcgtggccataaaaaaaattatccgtgtgattaaaaagaagcacagatagctggccagtcatatccggagtcatcacgtgcgaacccgtgtagacccccgggttggacacatcggccaaacaaagaaagcggccaatgtatcccggaggaatgataacactaagacgaagatacaacagaataaccccatgggggggaataacaaagttagtaggtgaataaaaacgataaacacccgaaactccctcctgcgtaggcaaaatagcgccctccccttccaaaacaacatacagcgcttccacagcagccatgacaaaagactcaaaacactcaaaagactcagtcttaccaggaaaataaaagcactctcacagcaccagcactaatcagagtgtgaagagggccaagtgccgaacgagtatatataggaattaaaaatgacgtaaatgtgtaaaggtcaaaaaacgcccagaaaaatacacagaccaacgcccgaaacgaaaacccgcgaaaaaatacccagaagttcctcaacaaccgccacttccgctttcccacgatacgtcacttcctcaaaaatagcaaactacatttcccacatgtacaaaaccaaaacccctccccttgtcaccgcccacaacttacataatcacaaacgtcaaagcctacgtcacccgccccgcctcgccccgcccacctcattatcatattggcctcaatccaaaataaggtatattattgatgatg

SEQ ID NO: 74 - protein, 500 aa, Human immunodeficiency virus
MGARASVLSGGELDKWEKIRLRPGGKKKYKLKHIVWASRELERFAVNPGLLETSEGCRQILGQLQPSLQTGSEELRSLYNTVATLYCVHQKIDVKDTKEALEKIEEEQNKSKKKAQQAAAGTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKVGHIAKNCRAPRKKGCWKCGKEGHQMKDCNERQANFLGKIWPSHKGRPGNFLQSRPEPTAPPEESFRFGEEKTTPSQKQEPIDKELYPLASLRSLFGNDPSSQ

The invention claimed is:

1. An isolated polynucleotide encoding an adenovirus hexon protein comprising:
A) (i) a HVR1 comprising an amino acid sequence according to SEQ ID NO: 11, or a variant thereof having at least 85% sequence identity and no A at position 27,
(ii) a HVR2 comprising an amino acid sequence according to SEQ ID NO: 12 or a variant thereof having at least 85% sequence identity and no L at position 1,
(iii) a HVR3 comprising an amino acid sequence according to SEQ ID NO: 13, or a variant thereof having at least 85% sequence identity and no V at position 7,
(iv) a HVR4 comprising an amino acid sequence according to SEQ ID NO: 14, or a variant thereof having at least 85% sequence identity,
(v) a HVR5 comprising an amino acid sequence according to SEQ ID NO: 15, or a variant thereof having at least 85% sequence identity,
(vi) a HVR6 comprising an amino acid sequence according to SEQ ID NO: 16, or a variant thereof having at least 85% sequence identity, and
(vii) a HVR7 comprising an amino acid sequence according to SEQ ID NO: 17, or a variant thereof having at least 85% sequence identity and no I at position 1; or B) (i) a HVR1 comprising an amino acid sequence according to SEQ ID NO: 18, or a variant thereof having at least 85% sequence identity and no V at position 8, no D at position 12, no E at position 13, and/or no L at position 14,
(ii) a HVR2 comprising an amino acid sequence according to SEQ ID NO: 19, or a variant thereof having at least 85% sequence identity and no D at position 10,
(iii) a HVR3 comprising an amino acid sequence according to SEQ ID NO: 20, or a variant thereof having at least 85% sequence identity and no T at position 6,
(iv) a HVR4 comprising an amino acid sequence according to SEQ ID NO: 21, or a variant thereof having at least 85% sequence identity and no L at position 9,
(v) a HVR5 comprising an amino acid sequence according to SEQ ID NO: 22, or a variant thereof having at least 85% sequence identity and no T at position 3,
(vi) a HVR6 comprising an amino acid sequence according to SEQ ID NO: 23, or a variant thereof having at least 85% sequence identity and no I at position 9, and
(vii) a HVR7 comprising an amino acid sequence according to SEQ ID NO: 24, or a variant thereof having at least 85% sequence identity and no I at position 8; or C) (i) a HVR1 comprising an amino acid sequence according to SEQ ID NO: 25, or a variant thereof having at least 85% sequence identity,
  (ii) a HVR2 comprising an amino acid sequence according to SEQ ID NO: 26, or a variant thereof having at least 85% sequence identity,
  (iii) a HVR3 comprising an amino acid sequence according to SEQ ID NO: 27, or a variant thereof having at least 85% sequence identity and no V at position 7,
  (iv) a HVR4 comprising an amino acid sequence according to SEQ ID NO: 28, or a variant thereof having at least 85% sequence identity and no E at position 10,
  (v) a HVR5 comprising an amino acid sequence according to SEQ ID NO: 29, or a variant thereof having at least 85% sequence identity and no T at position 3,
  (vi) a HVR6 comprising an amino acid sequence according to SEQ ID NO: 30, or a variant thereof having at least 85% sequence identity and no I at position 9, and
  (vii) a HVR7 comprising an amino acid sequence according to SEQ ID NO: 31, or a variant thereof having at least 85% sequence identity and no I at position 8 and/or no T at position 11; or
D) (i) a HVR1 comprising an amino acid sequence according to SEQ ID NO: 32, or a variant thereof having at least 85% sequence identity,
  (ii) a HVR2 comprising an amino acid sequence according to SEQ ID NO: 33, or a variant thereof having at least 85% sequence identity,
  (iii) a HVR3 comprising an amino acid sequence according to SEQ ID NO:34, or a variant thereof having at least 85% sequence identity and no T at position 6,
  (iv) a HVR4 comprising an amino acid sequence according to SEQ ID NO: 35, or a variant thereof having at least 85% sequence identity with no Q at position 6 and/or with no E at position 10,
  (v) a HVR5 comprising an amino acid sequence according to SEQ ID NO: 36, or a variant thereof having at least 85% sequence identity and no T at position 3,
  (vi) a HVR6 comprising an amino acid sequence according to SEQ ID NO: 37, or a variant thereof having at least 85% sequence identity and no K at position 1, and
  (vii) a HVR7 comprising an amino acid sequence according to SEQ ID NO: 38, or a variant thereof having at least 85% sequence identity and no I at position 8; or
E) (i) a HVR1 comprising an amino acid sequence according to SEQ ID NO: 39, or a variant thereof having at least 85% sequence identity and no A at position 27,
  (ii) a HVR2 comprising an amino acid sequence according to SEQ ID NO: 40, or a variant thereof having at least 85% sequence identity,
  (iii) a HVR3 comprising an amino acid sequence according to SEQ ID NO: 41, or a variant thereof having at least 85% sequence identity,
  (iv) a HVR4 comprising an amino acid sequence according to SEQ ID NO: 42, or a variant thereof having at least 85% sequence identity,
  (v) a HVR5 comprising an amino acid sequence according to SEQ ID NO: 43, or a variant thereof having at least 85% sequence identity,
  (vi) a HVR6 comprising an amino acid sequence according to SEQ ID NO: 44, or a variant thereof having at least 85% sequence identity, and
  (vii) a HVR7 comprising an amino acid sequence according to SEQ ID NO: 45, or a variant thereof having at least 85% sequence identity and no I at position 1.

2. The isolated polynucleotide of claim 1, wherein the hexon protein according to
  A) comprises an amino acid sequence according to SEQ ID NO: 46, or a variant thereof having at least 85% sequence identity,
  B) comprises an amino acid sequence according to SEQ ID NO: 47, or a variant thereof having at least 85% sequence identity,
  C) comprises an amino acid sequence according to SEQ ID NO: 48, or a variant thereof having at least 85% sequence identity,
  D) comprises an amino acid sequence according to SEQ ID NO: 49, or a variant thereof having at least 85% sequence identity, and/or
  E) comprises an amino acid sequence according to SEQ ID NO: 50, or a variant thereof having at least 85% sequence identity.

3. The isolated polynucleotide of claim 1, further encoding an adenoviral penton protein comprising an amino acid sequence according to SEQ ID NO: 51 or 52, or a variant thereof having at least 85% sequence identity.

4. The isolated polynucleotide of claim 1, further encoding an adenoviral fiber protein comprising an amino acid sequence according to SEQ ID NO: 53 or 54, or a variant thereof having at least 85% sequence identity.

5. The isolated polynucleotide of claim 1, further encoding a VA RNA II non-coding RNA comprising a nucleotide sequence according to SEQ ID NO: 57, or a variant thereof having at least 85% sequence identity, and/or a VA RNA I non-coding RNA comprising a nucleotide sequence according to SEQ ID NO: 55 or 56, or a variant thereof having at least 85% sequence identity.

6. An isolated polynucleotide encoding an adenovirus comprising the polynucleotide of claim 1.

7. The isolated polynucleotide of claim 6, wherein the adenovirus is a chimeric adenovirus and/or carries a non-adenoviral gene, protein or fragment thereof.

8. At least one isolated adenoviral capsid polypeptide encoded by an isolated polynucleotide of claim 1.

9. An isolated adenovirus, comprising an isolated polynucleotide according to claim 1.

10. A virus-like particle encoded by an isolated polynucleotide of claim 1.

11. A vector comprising an isolated polynucleotide of claim 1.

12. A composition comprising (i) an adjuvant, (ii) an isolated polynucleotide of claim 1, and optionally (iii) a pharmaceutically acceptable excipient.

13. A cell comprising a polynucleotide of claim 1.

14. A polynucleotide of claim 1 for use in treating or preventing a disease.

15. An in vitro method for producing an adenovirus or an adenovirus-like particle, comprising the steps of
  (i) expressing an isolated polynucleotide of claim 1 in a cell such that an adenovirus or an adenovirus-like particle is assembled in the cell, (ii) isolating the adenovirus or the adenovirus-like particle from the cell or the medium surrounding the cell.

\* \* \* \* \*